(12) United States Patent
Haertel et al.

(10) Patent No.: US 8,916,748 B2
(45) Date of Patent: Dec. 23, 2014

(54) NUCLEIC ACID MOLECULES ENCODING POLYPEPTIDES INVOLVED IN REGULATION OF SUGAR AND LIPID METABOLISM AND METHODS OF USE VIII

(75) Inventors: Heiko A. Haertel, Durham, NC (US); Garima Bhatt, Durham, NC (US)

(73) Assignee: BASF Plant Science GmbH, Ludwigshafen (DE)

(*) Notice: Subject to any disclaimer, the term of this patent is extended or adjusted under 35 U.S.C. 154(b) by 1594 days.

(21) Appl. No.: 12/096,301

(22) PCT Filed: Dec. 4, 2006

(86) PCT No.: PCT/EP2006/069271
§ 371 (c)(1),
(2), (4) Date: Jun. 5, 2008

(87) PCT Pub. No.: WO2007/065878
PCT Pub. Date: Jun. 14, 2007

(65) Prior Publication Data
US 2009/0170173 A1 Jul. 2, 2009

Related U.S. Application Data

(60) Provisional application No. 60/597,558, filed on Dec. 9, 2005.

(51) Int. Cl.
| | |
|---|---|
| C12N 15/82 | (2006.01) |
| A01H 5/00 | (2006.01) |
| C12P 21/04 | (2006.01) |
| C12N 9/00 | (2006.01) |
| C07K 14/415 | (2006.01) |
| C12N 9/10 | (2006.01) |
| C12N 9/12 | (2006.01) |

(52) U.S. Cl.
CPC .............. *C12N 15/8247* (2013.01); *C12N 9/00* (2013.01); *C12N 15/8234* (2013.01); *C12N 9/93* (2013.01); *C07K 14/415* (2013.01); *C12N 9/1051* (2013.01); *C12N 9/1205* (2013.01); *C12N 15/8245* (2013.01)
USPC .......... 800/281; 800/298; 435/419; 435/71.1; 435/70.1

(58) Field of Classification Search
None
See application file for complete search history.

(56) References Cited

U.S. PATENT DOCUMENTS

| | | | |
|---|---|---|---|
| 5,955,650 A | 9/1999 | Hitz | |
| 6,084,164 A | 7/2000 | Bidney et al. | |
| 2003/0084472 A1* | 5/2003 | Zou et al. ..................... | 800/278 |

FOREIGN PATENT DOCUMENTS

| | | |
|---|---|---|
| WO | WO-97/42326 A2 | 11/1997 |
| WO | WO-2004/013304 A2 | 2/2004 |
| WO | 2006069610 A2 * | 7/2006 |

OTHER PUBLICATIONS

Broun et al, Science 282: 1315-1317, Nov. 13, 1998.*
Van de Loo et al, PNAS, USA 92: 6743-6747, Jul. 1995.*
Doerks et al, TIG 14(6): 248-250, Jun. 1998.*
Brenner, SE, TIG 15(4): 132-133, Apr. 1999.*
Bork et al, TIG 12(10): 425-427, Oct. 1996.*
Theologis et al, Nature 408: 816-820 (2000).*
Töpfer, R., et al., "Modification of Plant Lipid Synthesis", Science, vol. 268, (1995), pp. 681-686.
Cahoon, E.B., et al., "Expression of a Coriander Desaturase Results in Petroselinic Acid Production in Transgenic Tobacco", Proc. Nat'l. Acad. Sci. USA, vol. 89, (1992), pp. 11184-11188.
Van De Loo, F.J., et al., "Unusual Fatty Acids", in Lipid Metabolism in Plants, T.S. Moore Jr. (ed.), CRC Press, Chapter 3, (1993), pp. 91-126.
Millar, A.A., et al., "All Fatty Acids are not Equal: Discrimination in Plant Membrane Lipids, Trends in Plant Science", vol. 5, No. 3, (2000), pp. 95-101.
Browse, J., et al., "Fluxes Through the Prokaryotic and Eukaryotic Pathways of Lipid Synthesis in the '16:3' Plant *Arabidopsis thaliana*", Biochem. J., vol. 235, (1986), pp. 25-31.
Ohlrogge, J, et al., "Lipid Biosynthesis", The Plant Cell, vol. 7, (1995), pp. 957-970.
Voelker, T., "Plant ACYL-ACP Thioesterases: Chain-Length Determining Enzymes in Plant Fatty Acid Biosynthesis", Genetic Engineering, vol. 18, (1996), pp. 111-133.
Shanklin, J., et al., "Desaturation and Related Modifications of Fatty Acids", Annu. Rev. Plant Physiol. Plant Mel. Biol., vol. 49, (1998), pp. 611-641.
Frentzen, M., "Acyltransferases from Basic Science to Modified Seed Oils", Lipids, vol. 100, (1998), pp. 161-166.
Plaxton, W.C., "The Organization and Regulation of Plant Glycolysis", Annu, Rev. Plant Physiol. Plant Mol. Biol., vol. 47, (1996), pp. 185-214.
Kang, F., et al., "Starch and Fatty Acid Synthesis in Plastids from Developing Embryos of Oilseed Rape (*Brassica napus* L.)", The Plant Journal, vol. 6, No. 6, (1994), pp. 795-805.
Van De Loo, F.J., et al., "An Oleate 12-Hydroxylase from *Ricinus communis* L. is a Fatty Acyl Desaturase Homolog", Proc. Nat'l Acad. Sci. USA, vol. 92, (1995), pp. 6743-6747.

(Continued)

*Primary Examiner* — Elizabeth McElwain
(74) *Attorney, Agent, or Firm* — Roberte M. D. Makowski

(57) ABSTRACT

This invention relates generally to nucleic acid sequences encoding proteins that are related to the presence of seed storage compounds in plants. More specifically, the present invention relates to *Arabidopsis thaliana, Brassica napus, Glycine max* and *Oryza sativa* nucleic acid sequences encoding sugar and lipid metabolism regulator proteins and the use of these sequences in transgenic plants. In particular, the invention is directed to methods for manipulating sugar-related compounds and for increasing oil level and altering the fatty acid composition in plants and seeds. The invention further relates to methods of using these novel plant polypeptides to stimulate plant growth and/or to increase yield and/or composition of seed storage compounds.

17 Claims, 27 Drawing Sheets

(56) References Cited

OTHER PUBLICATIONS

Brenner, R.R., "Regulatory Function of delta6 Desaturase—Key Enzyme of Polyunsaturated Fatty Acid Synthesis", Advances in Experimental Medicine and Biology, vol. 83, (1976), pp. 85-101.

Ritchie, S., et al., "Calcium-Dependent Protein Phosphorylation May Mediate the Gibberellic Acid Response in Barley Aleurone", Plant Physiol., (1998), vol. 116, pp. 765-776.

Arenas-Huertero, F., et al., "Analysis of *Arabidopsis* Glucose Insensitive Mutants, *gin5* and *gin6*, Reveals a Central Role of the Plant Hormone ABA in the Regulation of Plant Vegetative Development by Sugar", Genes & Development, vol. 14, (2000), pp. 2085-2096.

Kuo, A., et al., "Okadaic Acid, a Protein Phosphatase Inhibitor, Blocks Calcium Changes, i Gene Expression, and Cell Death Induced by Gibberellin in Wheat Aleurone Cells", The Plant Cell, vol. 8, (1996), pp. 259-269.

Cohen, P., "Signal Integration at the Level of Protein Kinases, Protein Phosphatases and their Substrates", Trends in Biochem. Sci., vol. 17, (1992), pp. 408-413.

Zhou, L, et al., "Glucose and Ethylene Signal Transduction Crosstalk Revealed by an *Arabidopsis* Glucose-Insensitive Mutant", Proc. Nat'l Acad. Sci. USA, vol. 95, (1998), pp. 10294-10299.

Beaudoin, N., et al., "Interactions Between Abscisic Acid and Ethylene Signaling Cascades", The Plant Cell, vol. 12, (2000), pp. 1103-1115.

Colón-Carmona, A., et al., "Aux/IAA Proteins are Phosphorylated by Phytochrome in Vitro", Plant Physiology, vol. 124, (2000), pp. 1728-1738.

Mitsukawa, N., et al., "Overexpression of an *Arabidopsis thaliana* High-Affinity Phosphate Transporter Gene in Tobacco Cultured Cells Enhances Cell Growth Under Phosphate-limited Conditions", Proc. Nat'l Acad. Sci. USA, vol. 94, (1997), pp. 7098-7102.

Hurry, V., et al., "The Role of Inorganic Phosphate in the Development of Freezing Tolerance and the Acclimatization of Photosynthesis to Low Temperature is Revealed by the *Pho* Mutants of *Arabidopsis thaliana*", The Plant Journal., vol. 24, No. 3, (2000), pp. 383-396.

Härtel, H., et al., "DGD1-Independent Biosynthesis of Extraplastidic Galactolipids after Phosphate Deprivation in *Arabidopsis*", PNAS, vol. 97, No. 19, (2000), pp. 10649-10654.

Savage, L.J., et al., "Phosphorylation of Pea Chloroplast Acetyl-CoA Carboxylase", The Plant Journal, vol. 18, No. 5, (1999), pp. 521-527.

Müller, M.-0., et al., "Lipid Phosphorylation in Chloroplast Envelopes", The Journal of Biological Chemistry, vol. 275, No. 26, (2000), pp. 19475-19481.

Merlot, S., et al., "The ABI1 and ABI2 Protein Phosphatases 2C Act in a Negative Feedback Regulatory Loop of the Abscisic Acid Signalling Pathway", The Plant Journal, vol. 25, No. 3, (2001), pp. 295-303.

Van Dijck, P., et al., "Truncation of *Arabidopsis thaliana* and *Selaginella lepidophylla* Trehalose-6-Phosphate Synthase Unlocks High Catalytic Activity and Supports High Trehalose Levels on Expression in Yeast", Biochemical Journal, vol. 366, No. 1, (2002), pp. 63-71.

"*Arabidopsis thaliana* trehalose-6-phosphate synthase 2 (TPS2) mRNA, complete cds", EMBL Database, Accession No. AF155150, Jan. 2, 2003.

F17O7.18 protein (Trehalose-6-phosphate synthase 2), Uniprot Database, Accession No. 064608, Aug. 1, 1998.

Avonce, N., et al., "The *Arabidopsis* Trehalose-6-P Synthase *AtTPS1* Gene is a Regulator of Glucose, Abscisic Acid, and Stress Signaling", Plant Physiology, vol. 136, (2004), pp. 3649-3659.

Eastmond, P.J., et al., "Is Trehalose-6-phosphate a Regulator of Sugar Metabolism in Plants?", Journal of Experimental Botany, vol. 54, No. 382,(2003), pp. 533-537.

"*Arabidopsis thaliana* putative trehalose 6-phosphate synthase (At1g23870) mRNA, complete cds", Database EMBL, Accession No. AY096366, May 7, 2002.

\* cited by examiner

Figure 1A: Nucleic acid sequence of pk321AT01

```
ATGGTGTCAAGATCTTGTGCTAATTTTCTAGACTTATCATCTTGGGACCTTTTAGATTTTCCTCAAACTCCAC
GAACTCTTCCACGCGTCATGACTGTTCCGGGAATCATCACCGACGTAGACGGTGATACAACCTCCGAACTA
ACTTCTACCTCCGGTGGTTCACGTGAGAGGAAGATCATTGTAGCTAACATGTTACCACTCCAATCTAAAAGA
GATGCAGAAACTGGTAAATGGTGTTTTAACTGGGACGAAGACTCTCTCCAGTTACAACTTAGAGATGGGTT
CTCTTCAGAAACAGAGTTTCTCTACGTTGGATCACTTAACGTAGACATCGAAACTAACGAACAAGAAGAAG
TTTCACAGAAGCTTTTAGAGGAATTTAACTGCGTTGCAACGTTTTTGTCTCAAGAGTTGCAAGAAATGTTCT
ATCTTGGTTTCTGTAAACATCAGTTATGGCCACTCTTTCATTACATGCTTCCAATGTTTCCTGATCATGGTG
ATCGTTTTGATCGACGTCTATGGCAAGCTTATGTATCAGCCAACAAGATATTTTCAGATAGAGTTATGGAAG
TTATCAACCCTGAGGATGATTACGTTTGGATTCAAGATTATCATCTTATGGTTCTTCCTACTTTCTTGAGGA
AACGTTTTAATAGGATCAAACTCGGTTTCTTCCTTCATAGTCCGTTTCCTTCTTCAGAGATTTACCGCACAT
TGCCTGTTCGTGACGAGATTTTGAGAGGTTTGTTGAATTGTGATCTCATTGGTTTCCATACGTTTGATTACG
CGAGGCATTTCTTGTCTTGTTGTAGTAGAATGCTTGGTCTTGATTACGAGTCTAAGCGCGGTCACATAGGTC
TTGATTACTTTGGTAGGACTGTGTATATCAAAATACTTCCTGTTGGTGTTCATATGGGTAGATTGGAGTCTG
TTTTGAGTCTTGATTCTACTGCGGCGAAGACGAAAGAGATTCAAGAACAGTTTAAAGGGAAGAAGCTTGTT
CTTGGTATCGATGATATGGATATATTTAAAGGGATAAGCTTAAAGCTTATAGCAATGGAACATCTCTTTGAG
ACTTATTGGCATTTGAAAGGGAAAGTTGTTCTTGTTCAGATAGTGAACCCTGCAAGATCTTCTGGTAAAGAT
GTTGAAGAAGCGAAGAGGGAGACGTATGAGACTGCGAGGAGGATCAATGAGCGTTACGGTACTTCTGACTA
TAAGCCGATAGTTTTGATCGATCGTCTTGTTCCACGTTCTGAGAAAACCGCGTATTATGCTGCAGCAGATTG
TTGCTTAGTGAATGCAGTGAGAGATGGTATGAACTTAGTTCCTTATAAGTATATCGTCTGCAGGCAGGGGA
CTCGAAGTAATAAGGCCGTTGTGGATTCATCGCCTCGCACAAGCACTCTTGTCGTGTCTGAGTTTATTGGAT
GCTCACCTTCTTTGAGTGGTGCCATTAGGGTGAATCCATGGGATGTGGATGCTGTTGCTGAAGCGGTAAAC
TCGGCTCTTAAAATGAGTGAGACTGAGAAGCAACTACGGCATGAGAAACATTATCATTATATTAGCACTCAT
GATGTTGGTTATTGGGCAAAGAGCTTTATGCAGGATCTTGAGAGAGCGTGCCGAGATCATTATAGTAAACG
TTGTTGGGGGATTGGTTTTGGTTTGGGGTTCAGAGTTTTGTCACTCTCTCCAAGTTTTAGGAAGCTATCTGT
GGAACACATTGTTCCAGTTTATAGAAAAACACAGAGAAGAGCTATATTTCTTGATTATGATGGTACTCTTGT
TCCTGAAAGCTCCATTGTTCAAGATCCAAGCAACGAGGTTGTCTCTGTTCTGAAAGCTCTCTGTGAAGATCC
GAATAACACGGTGTTTATTGTTAGTGGAAGAGGTAGAGAGTCTCTGAGCAATTGGCTATCTCCTTGTGAAAA
TCTTGGAATAGCAGCTGAACATGGATACTTCATTAGATGGAAGAGCAAAGATGAGTGGGAGACTTGTTATT
CGCCTACGGATACAGAGTGGAGGTCAATGGTGGAACCGGTTATGAGATCGTATATGGAGGCAACAGATGGG
ACGAGTATAGAGTTTAAAGAAAGTGCTTTGGTGTGGCACCATCAAGACGCAGATCCTGACTTTGGATCATG
TCAAGCTAAGGAGATGCTTGATCATCTAGAGAGTGTTCTCGCCAATGAGCCTGTGGTTGTCAAGAGAGGTC
AACACATCGTTGAAGTCAAACCACAAGGTGTAAGCAAAGGTCTAGCTGCGGAGAAAGTAATCCGAGAAATG
GTAGAACGCGGGGAGCCACCGGAAATGGTGATGTGCATAGGAGACGATAGATCAGACGAAGACATGTTTG
AGAGCATATTAAGCACAGTGACAAATCCGGAACTTCTTGTGCAGCCAGAGGTTTTTGCATGCACGGTTGGA
AGAAAACCAAGCAAAGCTAAATACTTCTTGGACGATGAAGCCGACGTGCTTAAGCTCCTAAGAGGTCTTGG
AGACTCATCATCGAGCTTAAAACCTAGTTCTTCTCACACACAAGTTGCATTTGAAAGCATCGTTTAA
```

Figure 1B:       Nucleic acid sequence of the open reading frame of pk321AT01

```
ATGGTGTCAAGATCTTGTGCTAATTTTCTAGACTTATCATCTTGGGACCTTTTAGATTTTCCTCAAACTCCAC
GAACTCTTCCACGCGTCATGACTGTTCCGGGAATCATCACCGACGTAGACGGTGATACAACCTCCGAAGTA
ACTTCTACCTCCGGTGGTTCACGTGAGAGGAAGATCATTGTAGCTAACATGTTACCACTCCAATCTAAAAGA
GATGCAGAAACTGGTAAATGGTGTTTTAACTGGGACGAAGACTCTCTCCAGTTACAACTTAGAGATGGGTT
CTCTTCAGAAACAGAGTTTCTCTACGTTGGATCACTTAACGTAGACATCGAAACTAACGAACAAGAAGAAG
TTTCACAGAAGCTTTTAGAGGAATTTAACTGCGTTGCAACGTTTTTGTCTCAAGAGTTGCAAGAAATGTTCT
ATCTTGGTTTCTGTAAACATCAGTTATGGCCACTCTTTCATTACATGCTTCCAATGTTTCCTGATCATGGTG
ATCGTTTTGATCGACGTCTATGGCAAGCTTATGTATCAGCCAACAAGATATTTTCAGATAGAGTTATGGAAG
TTATCAACCCTGAGGATGATTACGTTTGGATTCAAGATTATCATCTTATGGTTCTTCCTACTTTCTTGAGGA
AACGTTTTAATAGGATCAAACTCGGTTTCTTCCTTCATAGTCCGTTTCCTTCTTCAGAGATTTACCGCACAT
TGCCTGTTCGTGACGAGATTTTGAGAGGTTTGTTGAATTGTGATCTCATTGGTTTCCATACGTTTGATTACG
CGAGGCATTTCTTGTCTTGTTGTAGTAGAATGCTTGGTCTTGATTACGAGTCTAAGCGCGGTCACATAGGTC
TTGATTACTTTGGTAGGACTGTGTATATCAAAATACTTCCTGTTGGTGTTCATATGGGTAGATTGGAGTCTG
TTTTGAGTCTTGATTCTACTGCGGCGAAGACGAAAGAGATTCAAGAACAGTTTAAAGGGAAGAAGCTTGTT
CTTGGTATCGATGATATGGATATATTTAAAGGGATAAGCTTAAAGCTTATAGCAATGGAACATCTCTTTGAG
ACTTATTGGCATTTGAAAGGGAAAGTTGTTCTTGTTCAGATAGTGAACCCTGCAAGATCTTCTGGTAAAGAT
GTTGAAGAAGCGAAGAGGGAGACGTATGAGACTGCGAGGAGGATCAATGAGCGTTACGGTACTTCTGACTA
TAAGCCGATAGTTTTGATCGATCGTCTTGTTCCACGTTCTGAGAAAACCGCGTATTATGCTGCAGCAGATTG
TTGCTTAGTGAATGCAGTGAGAGATGGTATGAACTTAGTTCCTTATAAGTATATCGTCTGCAGGCAGGGGA
CTCGAAGTAATAAGGCCGTTGTGGATTCATCGCCTCGCACAAGCACTCTTGTCGTGTCTGAGTTTATTGGAT
GCTCACCTTCTTTGAGTGGTGCCATTAGGGTGAATCCATGGGATGTGGATGCTGTTGCTGAAGCGGTAAAC
TCGGCTCTTAAAATGAGTGAGACTGAGAAGCAACTACGGCATGAGAAACATTATCATTATATTAGCACTCAT
GATGTTGGTTATTGGGCAAAGAGCTTTATGCAGGATCTTGAGAGAGCGTGCCGAGATCATTATAGTAAACG
TTGTTGGGGGATTGGTTTTGGTTTGGGGTTCAGAGTTTTGTCACTCTCTCCAAGTTTTAGGAAGCTATCTGT
GGAACACATTGTTCCAGTTTATAGAAAAACACAGAGAAGAGCTATATTTCTTGATTATGATGGTACTCTTGT
TCCTGAAAGCTCCATTGTTCAAGATCCAAGCAACGAGGTTGTCTCTGTTCTGAAAGCTCTCTGTGAAGATCC
GAATAACACGGTGTTTATTGTTAGTGGAAGAGGTAGAGAGTCTCTGAGCAATTGGCTATCTCCTTGTGAAAA
TCTTGGAATAGCAGCTGAACATGGATACTTCATTAGATGGAAGAGCAAAGATGAGTGGGAGACTTGTTATT
CGCCTACGGATACAGAGTGGAGGTCAATGGTGGAACCGGTTATGAGATCGTATATGGAGGCAACAGATGGG
ACGAGTATAGAGTTTAAAGAAAGTGCTTTGGTGTGGCACCATCAAGACGCAGATCCTGACTTTGGATCATG
TCAAGCTAAGGAGATGCTTGATCATCTAGAGAGTGTTCTCGCCAATGAGCCTGTGGTTGTCAAGAGAGGTC
AACACATCGTTGAAGTCAAACCACAAGGTGTAAGCAAAGGTCTAGCTGCGGAGAAAGTAATCCGAGAAATG
GTAGAACGCGGGGAGCCACCGGAAATGGTGATGTGCATAGGAGACGATAGATCAGACGAAGACATGTTTG
AGAGCATATTAAGCACAGTGACAAATCCGGAACTTCTTGTGCAGCCAGAGGTTTTTGCATGCACGGTTGGA
AGAAAACCAAGCAAAGCTAAATACTTCTTGGACGATGAAGCCGACGTGCTTAAGCTCCTAAGAGGTCTTGG
AGACTCATCATCGAGCTTAAAAACCTAGTTCTTCTCACACACAAGTTGCATTTGAAAGCATCGTT
```

Figure 1C:   Amino acid sequence of the open reading frame of pk321AT01

MVSRSCANFLDLSSWDLLDFPQTPRTLPRVMTVPGIITDVDGDTTSEVTSTSGGSRERKIIVANMLPLQSKRDAETGK
WCFNWDEDSLQLQLRDGFSSETEFLYVGSLNVDIETNEQEEVSQKLLEEFNCVATFLSQELQEMFYLGFCKHQLWPLF
HYMLPMFPDHGDRFDRRLWQAYVSANKIFSDRVMEVINPEDDYVWIQDYHLMVLPTFLRKRFNRIKLGFFLHSPFPSS
EIYRTLPVRDEILRGLLNCDLIGFHTFDYARHFLSCCSRMLGLDYESKRGHIGLDYFGRTVYIKILPVGVHMGRLESVLS
LDSTAAKTKEIQEQFKGKKLVLGIDDMDIFKGISLKLIAMEHLFETYWHLKGKVVLVQIVNPARSSGKDVEEAKRETYE
TARRINERYGTSDYKPIVLIDRLVPRSEKTAYYAAADCCLVNAVRDGMNLVPYKYIVCRQGTRSNKAVVDSSPRTSTL
VVSEFIGCSPSLSGAIRVNPWDVDAVAEAVNSALKMSETEKQLRHEKHYHYISTHDVGYWAKSFMQDLERACRDHYS
KRCWGIGFGLGFRVLSLSPSFRKLSVEHIVPVYRKTQRRAIFLDYDGTLVPESSIVQDPSNEVVSVLKALCEDPNNTVFI
VSGRGRESLSNWLSPCENLGIAAEHGYFIRWKSKDEWETCYSPTDTEWRSMVEPVMRSYMEATDGTSIEFKESALVW
HHQDADPDFGSCQAKEMLDHLESVLANEPVVVKRGQHIVEVKPQGVSKGLAAEKVIREMVERGEPPEMVMCIGDDR
SDEDMFESILSTVTNPELLVQPEVFACTVGRKPSKAKYFLDDEADVLKLLRGLGDSSSSLKPSSSHTQVAFESIV

Figure 2A:   Nucleic acid sequence of pk322AT01

ATGTCTGCGATACTCCAAGGAGCTGGAGCTGCAACGGCTCTCTCGCCGTTTAATTCTATCGATTCCAACAA
ACTCGTTGCTCCTTCTCGCTCTTCTCTTTCAGTGAGGAGCAAGAGATACATTGTTGCCGGATCTGATAGTAA
AAGCTTTGGTTCTAGCCTCGTAGCTCGTCGCTCTGAGCCGTTGATACCAAATGCTGTTACGACGAAGGCGG
ACACTGCTGCGAGCTCTACTTCATCAAAGCCTGGACATGAGCTATTACTTTTCGAGGCTCTTCAAGAAGGTC
TAGAAGAAGAGATGGACAGAGATCCACATGTATGTGTCATGGGTGAAGATGTAGGCCATTACGGAGGCTCA
TACAAAGTAACTAAAGGCCTAGCTGATAAGTTTGGCGATCTCAGGGTTCTGGACACTCCAATCTGTGAAAA
CGCCTTCACCGGTATGGGCATTGGAGCCGCCATGACAGGACTAAGACCCGTCATCGAAGGTATGAACATGG
GGTTTCTACTCTTAGCCTTCAACCAAATCTCCAACAACTGTGGTATGCTTCACTATACATCCGGTGGTCAAT
TCACTATCCCGGTTGTTATCCGTGGGCCTGGAGGTGTGGGCCGGCAGCTCGGAGCCGAGCATTCCCAGCGT
CTCGAGTCTTACTTCCAGTCAATCCCTGGGATCCAGATGGTGGCTTGCTCAACACCTTACAACGCTAAAGG
ATTGATGAAAGCGGCGATAAGAAGTGAGAATCCTGTGATTCTGTTTGAACACGTTCTGCTCTATAACCTCAA
GGAGAGTATTCCGGATGAAGAATACATATGTAATCTGGAAGAAGCAGAAATGGTCAGACCCGGTGAACACA
TCACGATACTGACGTATTCAAGGATGAGGTACCATGTAATGCAGGCTGCAAAGACGCTGGTGAACAAAGGG
TATGATCCAGAGGTTATCGACATAAGGTCGTTGAAGCCGTTTGATCTCTACACAATTGGAAACTCGGTGAA
GAAGACACACCGGGTTTTGATTGTGGAGGAATGTATGAGAACGGGAGGAATCGGAGCCAGTTTGACGGCTG
CAATAAACGAGAACTTTCATGATTACTTAGATGCTCCGGTGATGTGTTTGTCTTCTCAGGATGTCCCAACTC
CTTACGCCGGTACATTGGAAGAATGGACGGTTGTTCAGCCAGCTCAGATCGTCACTGCCGTCGAACAACTT
TGCCAGTAA

Figure 2B: Nucleic acid sequence of the open reading frame of pk322AT01

```
ATGTCTGCGATACTCCAAGGAGCTGGAGCTGCAACGGCTCTCTCGCCGTTTAATTCTATCGATTCCAACAA
ACTCGTTGCTCCTTCTCGCTCTTCTCTTTCAGTGAGGAGCAAGAGATACATTGTTGCCGGATCTGATAGTAA
AAGCTTTGGTTCTAGCCTCGTAGCTCGTCGCTCTGAGCCGTTGATACCAAATGCTGTTACGACGAAGGCGG
ACACTGCTGCGAGCTCTACTTCATCAAAGCCTGGACATGAGCTATTACTTTTCGAGGCTCTTCAAGAAGGTC
TAGAAGAAGAGATGGACAGAGATCCACATGTATGTGTCATGGGTGAAGATGTAGGCCATTACGGAGGCTCA
TACAAAGTAACTAAAGGCCTAGCTGATAAGTTTGGCGATCTCAGGGTTCTGGACACTCCAATCTGTGAAAA
CGCCTTCACCGGTATGGGCATTGGAGCCGCCATGACAGGACTAAGACCCGTCATCGAAGGTATGAACATGG
GGTTTCTACTCTTAGCCTTCAACCAAATCTCCAACAACTGTGGTATGCTTCACTATACATCCGGTGGTCAAT
TCACTATCCCGGTTGTTATCCGTGGGCCTGGAGGTGTGGGCCGGCAGCTCGGAGCCGAGCATTCCCAGCGT
CTCGAGTCTTACTTCCAGTCAATCCCTGGGATCCAGATGGTGGCTTGCTCAACACCTTACAACGCTAAAGG
ATTGATGAAAGCGGCGATAAGAAGTGAGAATCCTGTGATTCTGTTTGAACACGTTCTGCTCTATAACCTCAA
GGAGAGTATTCCGGATGAAGAATACATATGTAATCTGGAAGAAGCAGAAATGGTCAGACCCGGTGAACACA
TCACGATACTGACGTATTCAAGGATGAGGTACCATGTAATGCAGGCTGCAAAGACGCTGGTGAACAAAGGC
TATGATCCAGAGGTTATCGACATAAGGTCGTTGAAGCCGTTTGATCTCTACACAATTGGAAACTCGGTGAA
GAAGACACACCGGGTTTTGATTGTGGAGGAATGTATGAGAACGGGAGGAATCGGAGCCAGTTTGACGGCTG
CAATAAACGAGAACTTTCATGATTACTTAGATGCTCCGGTGATGTGTTTGTCTTCTCAGGATGTCCCAACTC
CTTACGCCGGTACATTGGAAGAATGGACGGTTGTTCAGCCAGCTCAGATCGTCACTGCCGTCGAACAACTT
TGCCAG
```

Figure 2C: Amino acid sequence of the open reading frame of pk322AT01

MSAILQGAGAATALSPFNSIDSNKLVAPSRSSLSVRSKRYIVAGSDSKSFGSSLVARRSEPLIPNAVTTKADTAASSTSS
KPGHELLLFEALQEGLEEEMDRDPHVCVMGEDVGHYGGSYKVTKGLADKFGDLRVLDTPICENAFTGMGIGAAMTG
LRPVIEGMNMGFLLLAFNQISNNCGMLHYTSGGQFTIPVVIRGPGGVGRQLGAEHSQRLESYFQSIPGIQMVACSTPY
NAKGLMKAAIRSENPVILFEHVLLYNLKESIPDEEYICNLEEAEMVRPGEHITILTYSRMRYHVMQAAKTLVNKGYDPE
VIDIRSLKPFDLYTIGNSVKKTHRVLIVEECMRTGGIGASLTAAINENFHDYLDAPVMCLSSQDVPTPYAGTLEEWTVV
QPAQIVTAVEQLCQ

Figure 3A  Nucleic acid sequence of pk323AT01

```
ATGTCGTCGTCTGCGAAGAAACAAACCCTGTTCATATCGACATTAATCATCTCATGGTACTCTTCAAACATC
GGTGTTCTTCTCCTCAACAAGTTCCTTCTCTCGAATTACGGATTCAAATTCCCGATTTTTCTCACAATGTGT
CACATGTCCGCTTGCGCTATCCTTAGCTACATCTCCATTGTTTTCCTCAAGCTTGTTCCTCTCCAACATCTC
AAATCTCGTTCTCAATTCCTTAAGGTTGCTACTCTCAGCATCGTCTTTTGTGCTTCCGTCGTCGGTGGTAAC
ATCTCCCTTCGTTACCTTCCTGTCTCTTTCAATCAAGCCGTCGGTGCTACGACGCCGTTTTTCACGGCTCTG
TTTGCTTATCTTATGACCTTTAAGAGAGAAGCTTGGGTTACTTATGGTGCTCTCGTCCCTGTCGTCGCCGGT
GTCGTCATCGCCAGTGGGGGTGAGCCAGGATTTCACTGGTTTGGGTTCATAATGTGCATTAGTGCTACTGC
GGCAAGAGCCTTTAAATCTGTTCTTCAAGGCATCTTACTTTCTTCAGAGGGGGAAAAATTGAACTCAATGAA
TTTGATGTTGTATATGTCTCCCATAGCTGTCATTGCTCTTCTTCCCGTTACGCTATTTATGGAACCAGACGT
GATCAGTGTGACCTTGACGCTTGCAAAACAACATCAGTACATGTGGATACTTCTTCTGGTTAACTCTGTCAT
GGCTTATTCAGCCAATCTGTTGAATTTTCTGGTTACCAAACACACAAGCGCCCTCACCCTCCAGGTTCTTGG
AAATGCTAAAGGAGCAGTTGCAGTGGTGATTTCTATCTTGATCTTTCAAAACCCGGTTACGGTTATGGGAAT
TGGCGGGTACTCCATAACCGTCCTTGGGGTGGTTGCTTATGGAGAGACAAAACGCAGATTTAGATGA
```

Figure 3B:  Nucleic acid sequence of the open reading frame of pk323AT01

```
ATGTCGTCGTCTGCGAAGAAACAAACCCTGTTCATATCGACATTAATCATCTCATGGTACTCTTCAAACATC
GGTGTTCTTCTCCTCAACAAGTTCCTTCTCTCGAATTACGGATTCAAATTCCCGATTTTTCTCACAATGTGT
CACATGTCCGCTTGCGCTATCCTTAGCTACATCTCCATTGTTTTCCTCAAGCTTGTTCCTCTCCAACATCTC
AAATCTCGTTCTCAATTCCTTAAGGTTGCTACTCTCAGCATCGTCTTTTGTGCTTCCGTCGTCGGTGGTAAC
ATCTCCCTTCGTTACCTTCCTGTCTCTTTCAATCAAGCCGTCGGTGCTACGACGCCGTTTTTCACGGCTCTG
TTTGCTTATCTTATGACCTTTAAGAGAGAAGCTTGGGTTACTTATGGTGCTCTCGTCCCTGTCGTCGCCGGT
GTCGTCATCGCCAGTGGGGGTGAGCCAGGATTTCACTGGTTTGGGTTCATAATGTGCATTAGTGCTACTGC
GGCAAGAGCCTTTAAATCTGTTCTTCAAGGCATCTTACTTTCTTCAGAGGGGGAAAAATTGAACTCAATGAA
TTTGATGTTGTATATGTCTCCCATAGCTGTCATTGCTCTTCTTCCCGTTACGCTATTTATGGAACCAGACGT
GATCAGTGTGACCTTGACGCTTGCAAAACAACATCAGTACATGTGGATACTTCTTCTGGTTAACTCTGTCAT
GGCTTATTCAGCCAATCTGTTGAATTTTCTGGTTACCAAACACACAAGCGCCCTCACCCTCCAGGTTCTTGG
AAATGCTAAAGGAGCAGTTGCAGTGGTGATTTCTATCTTGATCTTTCAAAACCCGGTTACGGTTATGGGAAT
TGGCGGGTACTCCATAACCGTCCTTGGGGTGGTTGCTTATGGAGAGACAAAACGCAGATTTAGA
```

Figure 3C:       Amino acid sequence of the open reading frame of pk323AT01

MSSSAKKQTLFISTLIISWYSSNIGVLLLNKFLLSNYGFKFPIFLTMCHMSACAILSYISIVFLKLVPLQHLKSRSQFLKVAT
LSIVFCASVVGGNISLRYLPVSFNQAVGATTPFFTALFAYLMTFKREAWVTYGALVPVVAGVVIASGGEPGFHWFGFI
MCISATAARAFKSVLQGILLSSEGEKLNSMNLMLYMSPIAVIALLPVTLFMEPDVISVTLTLAKQHQYMWILLLVNSVM
AYSANLLNFLVTKHTSALTLQVLGNAKGAVAVVISILIFQNPVTVMGIGGYSITVLGVVAYGETKRRFR

Figure 4A:       Nucleic acid sequence of pk324AT01

ATGGCAACAGCAACATCAGCTTCTCTGTTTTCAACTGTTTCTTCATCTTACTCCAAAGCTAGCTCCATACCA
CATTCAAGACTCCAATCTGTGAAATTCAACTCAGTCCCTAGCTTCACCGGTCTCAAATCAACCTCTCTCATC
TCCGGATCTGATTCCTCTTCCTTAGCCAAGACTCTACGCGGTTCCGTAACGAAAGCACAAACATCTGACAA
GAAGCCTTACGGATTCAAAATCAACGCTTCATACAAAGTAGCTGTTCTTGGTGCTGCTGGTGGTATAGGTCA
GCCTTTATCACTTCTCATCAAGATGTCTCCGTTAGTCTCTACGCTTCATCTTTACGATATCGCCAATGTTAA
AGGAGTTGCTGCTGATCTAAGTCATTGTAACACTCCTTCTCAAGTTCGTGATTTCACTGGTCCTTCTGAGTT
AGCTGATTGTTTGAAAGATGTTAACGTTGTTGTCATCCCTGCTGGTGTGCCGAGGAAACCCGGTATGACTC
GTGACGATCTTTTCAACATCAATGCCAATATTGTCAAGACTCTTGTTGAAGCTGTTGCTGAGAATTGCCCTA
ATGCTTTCATTCATATTATTAGTAACCCGGTTAACTCTACGGTACCTATTGCTGCTGAAGTGTTGAAGAAGA
AAGGTGTTTATGATCCTAAGAAGCTGTTTGGTGTCACTACTTTGGATGTTGTGAGGGCTAACACTTTTGTTT
CTCAGAAGAAGAATCTTAAGCTTATTGATGTTGATGTTCCGGTTATTGGTGGACATGCTGGAATCACCATTT
TGCCTCTCCTCTCGAAGACAAAACCGTCTGTTAACTTTACTGATGAAGAGATCCAAGAGCTCACTGTTAGGA
TTCAGAACGCTGGTACTGAGGTTGTTGATGCTAAGGCAGGTGCAGGTTCAGCTACTTTGTCAATGGCTTAT
GCTGCTGCTAGATTTGTAGAGTCATCTCTTCGTGCTCTTGATGGAGACGGAGATGTCTACGAGTGCTCGTTT
GTGGAGTCGACTCTGACTGATCTTCCTTTCTTTGCATCACGGGTTAAGATAGGGAAGAACGGTCTTGAAGCT
GTGATTGAGTCAGACCTTCAGGGATTGACTGAGTATGAGCAGAAAGCACTAGAAGCTCTTAAGGTAGAATT
GAAAGCTAGCATTGACAAGGGTGTCGCATTTGCAAACAAACCAGCTGCTGCAGCAGCTAACTAG

Figure 4B: Nucleic acid sequence of the open reading frame of pk324AT01

```
ATGGCAACAGCAACATCAGCTTCTCTGTTTTCAACTGTTTCTTCATCTTACTCCAAAGCTAGCTCCATACCA
CATTCAAGACTCCAATCTGTGAAATTCAACTCAGTCCCTAGCTTCACCGGTCTCAAATCAACCTCTCTCATC
TCCGGATCTGATTCCTCTTCCTTAGCCAAGACTCTACGCGGTTCCGTAACGAAAGCACAAACATCTGACAA
GAAGCCTTACGGATTCAAAATCAACGCTTCATACAAAGTAGCTGTTCTTGGTGCTGCTGGTGGTATAGGTCA
GCCTTTATCACTTCTCATCAAGATGTCTCCGTTAGTCTCTACGCTTCATCTTTACGATATCGCCAATGTTAA
AGGAGTTGCTGCTGATCTAAGTCATTGTAACACTCCTTCTCAAGTTCGTGATTTCACTGGTCCTTCTGAGTT
AGCTGATTGTTTGAAAGATGTTAACGTTGTTGTCATCCCTGCTGGTGTGCCGAGGAAACCCGGTATGACTC
GTGACGATCTTTTCAACATCAATGCCAATATTGTCAAGACTCTTGTTGAAGCTGTTGCTGAGAATTGCCCTA
ATGCTTTCATTCATATTATTAGTAACCCGGTTAACTCTACGGTACCTATTGCTGCTGAAGTGTTGAAGAAGA
AAGGTGTTTATGATCCTAAGAAGCTGTTTGGTGTCACTACTTTGGATGTTGTGAGGGCTAACACTTTTGTTT
CTCAGAAGAAGAATCTTAAGCTTATTGATGTTGATGTTCCGGTTATTGGTGGACATGCTGGAATCACCATTT
TGCCTCTCCTCTCGAAGACAAAACCGTCTGTTAACTTTACTGATGAAGAGATCCAAGAGCTCACTGTTAGGA
TTCAGAACGCTGGTACTGAGGTTGTTGATGCTAAGGCAGGTGCAGGTTCAGCTACTTTGTCAATGGCTTAT
GCTGCTGCTAGATTTGTAGAGTCATCTCTTCGTGCTCTTGATGGAGACGGAGATGTCTACGAGTGCTCGTTT
GTGGAGTCGACTCTGACTGATCTTCCTTTCTTTGCATCACGGGTTAAGATAGGGAAGAACGGTCTTGAAGCT
GTGATTGAGTCAGACCTTCAGGGATTGACTGAGTATGAGCAGAAAGCACTAGAAGCTCTTAAGGTAGAATT
GAAAGCTAGCATTGACAAGGGTGTCGCATTTGCAAACAAACCAGCTGCTGCAGCAGCTAAC
```

Figure 4C: Amino acid sequence of the open reading frame of pk324AT01

```
MATATSASLFSTVSSSYSKASSIPHSRLQSVKFNSVPSFTGLKSTSLISGSDSSSLAKTLRGSVTKAQTSDKKPYGFKINA
SYKVAVLGAAGGIGQPLSLLIKMSPLVSTLHLYDIANVKGVAADLSHCNTPSQVRDFTGPSELADCLKDVNVVIPAG
VPRKPGMTRDDLFNINANIVKTLVEAVAENCPNAFIHIISNPVNSTVPIAAEVLKKKGVYDPKKLFGVTTLDVVRANTF
VSQKKNLKLIDVDVPVIGGHAGITILPLLSKTKPSVNFTDEEIQELTVRIQNAGTEVVDAKAGAGSATLSMAYAAARFV
ESSLRALDGDGDVYECSFVESTLTDLPFFASRVKIGKNGLEAVIESDLQGLTEYEQKALEALKVELKASIDKGVAFANKP
AAAAAN
```

Figure 5A: Nucleic acid sequence of pk325AT01

ATGGCGTCTCTTCTCGGAAGATCTCCTTCTTCAATCTTGACCTGCCCTCGTATTTCTTCTCCTTCCTCAACA
TCTTCAATGTCCCATCTCTGCTTCGGACCAGAGAAACTTTCTGGAAGAATCCAATTCAATCCAAAGAAGAAC
AGATCTCGTTACCATGTCTCTGTTATGAATGTCGCTACAGAGATCAACTCTGTTGAACAAGCAAAGAAGATT
GATTCAAAGGAAAGTGCAAGACCTGTTTATCCGTTTGCTGCTATAGTTGGACAAGATGAGATGAAGCTATG
CCTTTTGTTAAATGTGATTGACCCGAAGATAGGTGGTGTGATGATAATGGGAGATAGAGGAACTGGTAAAT
CAACAACTGTTAGATCTTTAGTTGATTTGCTTCCTGAGATCACTGTTGTTTCTGGTGATCCGTATAACTCAG
ACCCGAGAGATCCTGAGTGTATGGGAAAGGAAGTAAGAGAGAAAGTTCAAAAGGGAGAAGAATTGTCTGTT
ATTGAAACCAAAATCAATATGGTTGATCTTCCTTTGGGTGCTACTGAAGATAGAGTTTGTGGAACTATTGAT
ATCGAAAAGGCTTTAACCGAAGGTGTTAAGGCGTTTGAGCCTGGACTACTAGCTAAAGCTAATAGAGGGAT
TCTTTATGTTGATGAAGTTAATCTTTTGGATGATCATTTAGTTGATGTTCTTCTTGATTCAGCTGCATCTGGT
TGGAACACTGTTGAAAGAGAAGGGATATCGATTTCTCATCCTGCTCGGTTTATCCTCATTGGTTCAGGAAAT
CCTGAAGAAGGAGAGCTTAGACCACAGCTTCTTGACAGGTTTGGTATGCACGCGCAAGTAGGGACGGTTAG
AGACGCCGAGCTGAGAGTTAAGATTGTTGAAGAACGAGCTCGTTTCGATAGTAACCCAAAGGAGTTTCGAG
AAACTTATCAAGAAGAACAACTGAAGCTTCAGGAGCAGATTACAACTGCAAGAAGCAATCTTTCTGCAGTT
CAGATTGATCAAGATTTGAAAGTGAAGATCTCTAAGGTCTGTGCTGAGCTGGACGTTGATGGATTGAGAGG
AGACATGGTGATAAACAGAGCAGCTAGAGCGCTTGCAGCACTCCAAGGAAGAGATCAAGTTACAGCTGAAG
ATGTTGGTATTGTTATACCGAATTGTTTGAGACACAGACTCAGAAAAGATCCATTGGAGTCTATGGATTCGG
GAATTCTCGTTACCGAGAAGTTCTATGAGGTTTTCACTTAG

Figure 5B: Nucleic acid sequence of the open reading frame of pk325AT01

ATGGCGTCTCTTCTCGGAAGATCTCCTTCTTCAATCTTGACCTGCCCTCGTATTTCTTCTCCTTCCTCAACA
TCTTCAATGTCCCATCTCTGCTTCGGACCAGAGAAACTTTCTGGAAGAATCCAATTCAATCCAAAGAAGAAC
AGATCTCGTTACCATGTCTCTGTTATGAATGTCGCTACAGAGATCAACTCTGTTGAACAAGCAAAGAAGATT
GATTCAAAGGAAAGTGCAAGACCTGTTTATCCGTTTGCTGCTATAGTTGGACAAGATGAGATGAAGCTATG
CCTTTTGTTAAATGTGATTGACCCGAAGATAGGTGGTGTGATGATAATGGGAGATAGAGGAACTGGTAAAT
CAACAACTGTTAGATCTTTAGTTGATTTGCTTCCTGAGATCACTGTTGTTTCTGGTGATCCGTATAACTCAG
ACCCGAGAGATCCTGAGTGTATGGGAAAGGAAGTAAGAGAGAAAGTTCAAAAGGGAGAAGAATTGTCTGTT
ATTGAAACCAAAATCAATATGGTTGATCTTCCTTTGGGTGCTACTGAAGATAGAGTTTGTGGAACTATTGAT
ATCGAAAAGGCTTTAACCGAAGGTGTTAAGGCGTTTGAGCCTGGACTACTAGCTAAAGCTAATAGAGGGAT
TCTTTATGTTGATGAAGTTAATCTTTTGGATGATCATTTAGTTGATGTTCTTCTTGATTCAGCTGCATCTGGT
TGGAACACTGTTGAAAGAGAAGGGATATCGATTTCTCATCCTGCTCGGTTTATCCTCATTGGTTCAGGAAAT
CCTGAAGAAGGAGAGCTTAGACCACAGCTTCTTGACAGGTTTGGTATGCACGCGCAAGTAGGGACGGTTAG
AGACGCCGAGCTGAGAGTTAAGATTGTTGAAGAACGAGCTCGTTTCGATAGTAACCCAAAGGAGTTTCGAG
AAACTTATCAAGAAGAACAACTGAAGCTTCAGGAGCAGATTACAACTGCAAGAAGCAATCTTTCTGCAGTT
CAGATTGATCAAGATTTGAAAGTGAAGATCTCTAAGGTCTGTGCTGAGCTGGACGTTGATGGATTGAGAGG
AGACATGGTGATAAACAGAGCAGCTAGAGCGCTTGCAGCACTCCAAGGAAGAGATCAAGTTACAGCTGAAG
ATGTTGGTATTGTTATACCGAATTGTTTGAGACACAGACTCAGAAAAGATCCATTGGAGTCTATGGATTCGG
GAATTCTCGTTACCGAGAAGTTCTATGAGGTTTTCACT

Figure 5C:     Amino acid sequence of the open reading frame of pk325AT01

MASLLGRSPSSILTCPRISSPSSTSSMSHLCFGPEKLSGRIQFNPKKNRSRYHVSVMNVATEINSVEQAKKIDSKESARPV
YPFAAIVGQDEMKLCLLLNVIDPKIGGVMIMGDRGTGKSTTVRSLVDLLPEITVVSGDPYNSDPRDPECMGKEVREKV
QKGEELSVIETKINMVDLPLGATEDRVCGTIDIEKALTEGVKAFEPGLLAKANRGILYVDEVNLLDDHLVDVLLDSAAS
GWNTVEREGISISHPARFILIGSGNPEEGELRPQLLDRFGMHAQVGTVRDAELRVKIVEERARFDSNPKEFRETYQEEQL
KLQEQITTARSNLSAVQIDQDLKVKISKVCAELDVDGLRGDMVINRAARALAALQGRDQVTAEDVGIVIPNCLRHRL
RKDPLESMDSGILVTEKFYEVFT

Figure 6A:     Nucleic acid sequence of pk326AT01

ATGGCCCTTCAAGCTGCTTCTTTGGTCTCCTCTGCTTTCTCTGTTCGCAAAGATGCGAAGTTGAATGCTTCT
TCATCATCTTTCAAGGACTCGAGTCTTTTTGGTGCCTCCATTACCGACCAAATCAAATCCGAACATGGATCT
TCCTCGTTAAGATTCAAGAGAGAACAGAGCTTAAGGAATCTAGCAATTCGAGCCCAAACCGCTGCGACTTC
AAGCCCTACAGTTACAAAATCCGTGGACGGCAAGAAAACGTTGAGGAAAGGAAATGTGGTGGTCACTGGAG
CCTCGTCTGGGTTAGGTCTAGCCACGGCTAAAGCTCTAGCTGAGACAGGGAAATGGAACGTGATAATGGCG
TGCAGAGACTTCCTTAAAGCCGAGAGAGCTGCTAAATCCGTAGGGATGCCTAAAGACAGCTACACAGTGAT
GCATTTAGACTTAGCCTCGTTGGACAGCGTGAGACAGTTTGTTGATAATTTCAGGAGAACAGAGACGCCTC
TCGATGTTTTGGTCTGCAATGCTGCGGTTTATTTCCCGACAGCTAAAGAGCCTACTTACAGTGCTGAAGGGT
TTGAGCTTAGTGTTGCGACGAACCATTTGGGACATTTTCTTCTCGCAAGGTTGTTGCTTGATGACTTGAAGA
AATCTGATTACCCTTCAAAGCGTCTCATCATCGTCGGATCCATTACCGGGAACACGAATACATTGGCGGGT
AATGTACCACCGAAGGCGAATCTCGGTGATTTGAGGGGTTTAGCCGGCGGATTAAACGGTTTAAACAGCTC
AGCTATGATTGATGGAGGAGATTTCGACGGTGCAAAGGCTTACAAAGACAGTAAAGTCTGCAATATGTTGA
CAATGCAAGAGTTTCACAGGCGTTTCCATGAAGAAACTGGAGTCACTTTCGCTTCGCTTTACCCCGGTTGCA
TCGCCTCCACAGGTTTATTCCGAGAGCACATTCCTCTCTTCCGTGCCCTCTTCCCTCCCTTTCAGAAGTACA
TCACTAAAGGATATGTCTCCGAAACAGAGTCAGGCAAAAGACTTGCTCAGGTGGTGAGTGATCCAAGCTTG
ACGAAATCAGGGGTTTATTGGAGCTGGAACAATGCTTCGGCTTCTTTTGAGAACCAGTTATCAGAAGAAGC
AAGTGACGTTGAGAAGGCTCGTAAAGTGTGGGAGATCAGTGAGAAGCTCGTGGGCTTGGCCTAA

Figure 6B:    Nucleic acid sequence of the open reading frame of pk326AT01

```
ATGGCCCTTCAAGCTGCTTCTTTGGTCTCCTCTGCTTTCTCTGTTCGCAAAGATGCGAAGTTGAATGCTTCT
TCATCATCTTTCAAGGACTCGAGTCTTTTTGGTGCCTCCATTACCGACCAAATCAAATCCGAACATGGATCT
TCCTCGTTAAGATTCAAGAGAGAACAGAGCTTAAGGAATCTAGCAATTCGAGCCCAAACCGCTGCGACTTC
AAGCCCTACAGTTACAAAATCCGTGGACGGCAAGAAAACGTTGAGGAAAGGAAATGTGGTGGTCACTGGAG
CCTCGTCTGGGTTAGGTCTAGCCACGGCTAAAGCTCTAGCTGAGACAGGGAAATGGAACGTGATAATGGCG
TGCAGAGACTTCCTTAAAGCCGAGAGAGCTGCTAAATCCGTAGGGATGCCTAAAGACAGCTACACAGTGAT
GCATTTAGACTTAGCCTCGTTGGACAGCGTGAGACAGTTTGTTGATAATTTCAGGAGAACAGAGACGCCTC
TCGATGTTTTGGTCTGCAATGCTGCGGTTTATTTCCCGACAGCTAAAGAGCCTACTTACAGTGCTGAAGGGT
TTGAGCTTAGTGTTGCGACGAACCATTTGGGACATTTTCTTCTCGCAAGGTTGTTGCTTGATGACTTGAAGA
AATCTGATTACCCTTCAAAGCGTCTCATCATCGTCGGATCCATTACCGGGAACACGAATACATTGGCGGGT
AATGTACCACCGAAGGCGAATCTCGGTGATTTGAGGGGTTTAGCCGGCGGATTAAACGGTTTAAACAGCTC
AGCTATGATTGATGGAGGAGATTTCGACGGTGCAAAGGCTTACAAAGACAGTAAAGTCTGCAATATGTTGA
CAATGCAAGAGTTTCACAGGCGTTTCCATGAAGAAACTGGAGTCACTTTCGCTTCGCTTTACCCCGGTTGCA
TCGCCTCCACAGGTTTATTCCGAGAGCACATTCCTCTCTTCCGTGCCCTCTTCCCTCCCTTTCAGAAGTACA
TCACTAAAGGATATGTCTCCGAAACAGAGTCAGGCAAAAGACTTGCTCAGGTGGTGAGTGATCCAAGCTTG
ACGAAATCAGGGGTTTATTGGAGCTGGAACAATGCTTCGGCTTCTTTTGAGAACCAGTTATCAGAAGAAGC
AAGTGACGTTGAGAAGGCTCGTAAAGTGTGGGAGATCAGTGAGAAGCTCGTGGGCTTGGCC
```

Figure 6C:    Amino acid sequence of the open reading frame of pk326AT01

```
MALQAASLVSSAFSVRKDAKLNASSSSFKDSSLFGASITDQIKSEHGSSSLRFKREQSLRNLAIRAQTAATSSPTVTKSV
DGKKTLRKGNVVVTGASSGLGLATAKALAETGKWNVIMACRDFLKAERAAKSVGMPKDSYTVMHLDLASLDSVRQ
FVDNFRRTETPLDVLVCNAAVYFPTAKEPTYSAEGFELSVATNHLGHFLLARLLLDDLKKSDYPSKRLIIVGSITGNTN
TLAGNVPPKANLGDLRGLAGGLNGLNSSAMIDGGDFDGAKAYKDSKVCNMLTMQEFHRRFHEETGVTFASLYPGC
IASTGLFREHIPLFRALFPPFQKYITKGYVSETESGKRLAQVVSDPSLTKSGVYWSWNNASASFENQLSEEASDVEKARK
VWEISEKLVGLA
```

Figure 7A:     Nucleic acid sequence of pk327AT01

ATGGCCGCCTCGACAATGGCTCTCTCCTCTCCTGCTTTGACCGGAAAGGCCGTTAAGCTATCCCCGGCGGC
CTCCGAAGTATTTGGAACCGGCCGAATCACCATGCGCAAAGCCTCCAAGCCCACCGGTCCATCCGGCAGCC
CATGGTACGGATCCGACCGAGTCAAGTACTTGGGTCCATTCTCCGGTGAGCCTCCGAGCTACCTCACTGGA
GAGTTCCCCGGTGATTACGGGTGGGACACTGCCGGTCTATCCGCCGATCCCGAGACCTTCGCTAGGAACCG
TGAGCTAGAAGTTATCCACAGCAGATGGGCCATGCTCGGAGCCCTAGGCTGCGTTTTCCCTGAGCTATTGG
CTAGGAACGGAGTGAAGTTCGGAGAAGCGGTTTGGTTCAAGGCTGGTTCACAGATCTTCAGCGACGGAGGA
TTGGACTACTTGGGCAACCCGAGCTTGGTCCACGCTCAGAGCATCTTAGCCATTTGGGCTACTCAAGTTAT
CCTCATGGGAGCTGTTGAGGGCTACAGAGTCGCCGGAGATGGTCCATTGGGAGAAGCAGAGGACTTGCTTT
ACCCAGGTGGGAGCTTCGACCCATTGGGCCTCGCTACTGACCCCGAGGCTTTCGCGGAGTTGAAGGTGAAG
GAGCTCAAGAACGGAAGGTTGGCTATGTTCTCTATGTTTGGATTCTTCGTTCAGGCCATTGTCACCGGAAAG
GGACCGTTGGAGAACCTCGCGGACCACTTGGCTGATCCAGTCAACAACAATGCATGGGCCTTCGCTACCAA
CTTCGTCCCCGGAAAGTGA

Figure 7B:     Nucleic acid sequence of the open reading frame of pk327AT01

ATGGCCGCCTCGACAATGGCTCTCTCCTCTCCTGCTTTGACCGGAAAGGCCGTTAAGCTATCCCCGGCGGC
CTCCGAAGTATTTGGAACCGGCCGAATCACCATGCGCAAAGCCTCCAAGCCCACCGGTCCATCCGGCAGCC
CATGGTACGGATCCGACCGAGTCAAGTACTTGGGTCCATTCTCCGGTGAGCCTCCGAGCTACCTCACTGGA
GAGTTCCCCGGTGATTACGGGTGGGACACTGCCGGTCTATCCGCCGATCCCGAGACCTTCGCTAGGAACCG
TGAGCTAGAAGTTATCCACAGCAGATGGGCCATGCTCGGAGCCCTAGGCTGCGTTTTCCCTGAGCTATTGG
CTAGGAACGGAGTGAAGTTCGGAGAAGCGGTTTGGTTCAAGGCTGGTTCACAGATCTTCAGCGACGGAGGA
TTGGACTACTTGGGCAACCCGAGCTTGGTCCACGCTCAGAGCATCTTAGCCATTTGGGCTACTCAAGTTAT
CCTCATGGGAGCTGTTGAGGGCTACAGAGTCGCCGGAGATGGTCCATTGGGAGAAGCAGAGGACTTGCTTT
ACCCAGGTGGGAGCTTCGACCCATTGGGCCTCGCTACTGACCCCGAGGCTTTCGCGGAGTTGAAGGTGAAG
GAGCTCAAGAACGGAAGGTTGGCTATGTTCTCTATGTTTGGATTCTTCGTTCAGGCCATTGTCACCGGAAAG
GGACCGTTGGAGAACCTCGCGGACCACTTGGCTGATCCAGTCAACAACAATGCATGGGCCTTCGCTACCAA
CTTCGTCCCCGGAAAG

Figure 7C:     Amino acid sequence of the open reading frame of pk327AT01

MAASTMALSSPALTGKAVKLSPAASEVFGTGRITMRKASKPTGPSGSPWYGSDRVKYLGPFSGEPPSYLTGEFPGDYG
WDTAGLSADPETFARNRELEVIHSRWAMLGALGCVFPELLARNGVKFGEAVWFKAGSQIFSDGGLDYLGNPSLVHA
QSILAIWATQVILMGAVEGYRVAGDGPLGEAEDLLYPGGSFDPLGLATDPEAFAELKVKELKNGRLAMFSMFGFFVQ
AIVTGKGPLENLADHLADPVNNNAWAFATNFVPGK

Figure 8A:    Nucleic acid sequence of Atpk328

ATGGCCGCAACATCCGCCGCTGCTGCAGCTGCTTCTTCCATCATGGGTACTCGGGTGGCTCCCGGTATCCA
TCCCGGTTCAGGTCGGTTCACAGCCGTGTTCGGTTTCGGAAAGAAGAAGGCAGCTCCCAAAAAGAGTGCCA
AAAAGACGGTGACTACGGACCGGCCTCTTTGGTACCCAGGCGCCATTTCTCCTGACTGGCTTGATGGTTCC
TTGGTTGGAGATTACGGTTTTGATCCCTTCGGTTTAGGCAAACCGGCCGAGTATCTTCAATTCGATATCGAT
TCACTAGACCAGAATCTGGCTAAGAACTTGGCCGGAGACGTGATCGGAACCCGTACGGAAGCTGCCGACGC
CAAATCGACGCCGTTTCAGCCGTACAGTGAGGTGTTCGGAATCCAGAGATTCAGGGAATGCGAACTCATCC
ACGGACGGTGGGCGATGCTCGCTACTCTCGGCGCTCTCTCCGTCGAATGGCTTACCGGCGTTACATGGCAA
GACGCTGGCAAGGTGGAGCTTGTAGATGGATCGTCCTACTTGGGGCAGCCATTACCTTTCTCGATCTCGAC
ATTGATATGGATCGAGGTGTTAGTGATCGGCTACATCGAGTTCCAGCGCAACGCCGAGCTTGATTCGGAGA
AGCGTTTATACCCCGGAGGCAAGTTCTTTGACCCGCTAGGTTTAGCGGCTGACCCGGAGAAGACTGCTCAA
CTTCAGTTAGCTGAGATCAAGCATGCACGTCTTGCGATGGTCGCCTTCTTGGGATTCGCGGTTCAAGCGGC
TGCAACAGGTAAAGGTCCACTCAACAATTGGGCTACTCACCTCAGTGATCCACTCCACACCACCATCATCG
ATACCTTCTCCTCATCTTAA

Figure 8B:    Nucleic acid sequence of the open reading frame of pk328AT01

ATGGCCGCAACATCCGCCGCTGCTGCAGCTGCTTCTTCCATCATGGGTACTCGGGTGGCTCCCGGTATCCA
TCCCGGTTCAGGTCGGTTCACAGCCGTGTTCGGTTTCGGAAAGAAGAAGGCAGCTCCCAAAAAGAGTGCCA
AAAAGACGGTGACTACGGACCGGCCTCTTTGGTACCCAGGCGCCATTTCTCCTGACTGGCTTGATGGTTCC
TTGGTTGGAGATTACGGTTTTGATCCCTTCGGTTTAGGCAAACCGGCCGAGTATCTTCAATTCGATATCGAT
TCACTAGACCAGAATCTGGCTAAGAACTTGGCCGGAGACGTGATCGGAACCCGTACGGAAGCTGCCGACGC
CAAATCGACGCCGTTTCAGCCGTACAGTGAGGTGTTCGGAATCCAGAGATTCAGGGAATGCGAACTCATCC
ACGGACGGTGGGCGATGCTCGCTACTCTCGGCGCTCTCTCCGTCGAATGGCTTACCGGCGTTACATGGCAA
GACGCTGGCAAGGTGGAGCTTGTAGATGGATCGTCCTACTTGGGGCAGCCATTACCTTTCTCGATCTCGAC
ATTGATATGGATCGAGGTGTTAGTGATCGGCTACATCGAGTTCCAGCGCAACGCCGAGCTTGATTCGGAGA
AGCGTTTATACCCCGGAGGCAAGTTCTTTGACCCGCTAGGTTTAGCGGCTGACCCGGAGAAGACTGCTCAA
CTTCAGTTAGCTGAGATCAAGCATGCACGTCTTGCGATGGTCGCCTTCTTGGGATTCGCGGTTCAAGCGGC
TGCAACAGGTAAAGGTCCACTCAACAATTGGGCTACTCACCTCAGTGATCCACTCCACACCACCATCATCG
ATACCTTCTCCTCATCT

Figure 8C:    Amino acid sequence of the open reading frame of pk328AT01

MAATSAAAAAASSIMGTRVAPGIHPGSGRFTAVFGFGKKKAAPKKSAKKTVTTDRPLWYPGAISPDWLDGSLVGDY
GFDPFGLGKPAEYLQFDIDSLDQNLAKNLAGDVIGTRTEAADAKSTPFQPYSEVFGIQRFRECELIHGRWAMLATLGA
LSVEWLTGVTWQDAGKVELVDGSSYLGQPLPFSISTLIWIEVLVIGYIEFQRNAELDSEKRLYPGGKFFDPLGLAADPEK
TAQLQLAEIKHARLAMVAFLGFAVQAAATGKGPLNNWATHLSDPLHTTIIDTFSSS

Figure 9A:     Nucleic acid sequence of pk329AT01

```
ATGGCTACTGTCACTACTCATGCCTCGGCCTCGATTTTCCGACCTTGTACTTCAAAGCCAAGATTCCTCACC
GGTTCTTCCGGTAGGTTGAACCGCGACTTGTCGTTTACATCGATCGGTTCATCGGCCAAAACGTCGTCGTTC
AAGGTTGAAGCTAAGAAAGGAGAATGGTTGCCCGGTTTGGCATCGCCTGATTATCTCACCGGCAGTCTTGC
CGGTGACAATGGGTTTGACCCGTTGGGTCTAGCAGAGGATCCAGAGAACTTGAAATGGTTCGTCCAGGCAG
AGCTGGTCAACGGACGATGGGCTATGCTCGGTGTCGCTGGGATGCTTTTGCCGGAAGTTTTCACCAAGATC
GGAATCATAAATGTTCCTGAGTGGTACGATGCTGGGAAAGAGCAGTATTTTGCATCGTCGTCGACATTGTTC
GTGATCGAGTTCATATTGTTTCATTACGTTGAGATCAGACGGTGGCAAGACATCAAGAACCCAGGAAGTGT
GAACCAAGACCCTATCTTTAAGCAATACAGCTTACCTAAGGGTGAAGTTGGTTACCCTGGTGGAATCTTTAA
CCCGCTTAACTTTGCTCCTACGCAAGAGGCCAAGGAGAAAGAGCTAGCAAACGGGAGGTTGGCGATGTTGG
CATTCTTAGGGTTTGTGGTTCAACACAATGTGACTGGAAAAGGACCATTTGAGAATCTGTTGCAGCACTTGT
CTGACCCATGGCACAACACTATTGTCCAAACCTTCAACTAA
```

Figure 9B:     Nucleic acid sequence of the open reading frame of pk329AT01

```
ATGGCTACTGTCACTACTCATGCCTCGGCCTCGATTTTCCGACCTTGTACTTCAAAGCCAAGATTCCTCACC
GGTTCTTCCGGTAGGTTGAACCGCGACTTGTCGTTTACATCGATCGGTTCATCGGCCAAAACGTCGTCGTTC
AAGGTTGAAGCTAAGAAAGGAGAATGGTTGCCCGGTTTGGCATCGCCTGATTATCTCACCGGCAGTCTTGC
CGGTGACAATGGGTTTGACCCGTTGGGTCTAGCAGAGGATCCAGAGAACTTGAAATGGTTCGTCCAGGCAG
AGCTGGTCAACGGACGATGGGCTATGCTCGGTGTCGCTGGGATGCTTTTGCCGGAAGTTTTCACCAAGATC
GGAATCATAAATGTTCCTGAGTGGTACGATGCTGGGAAAGAGCAGTATTTTGCATCGTCGTCGACATTGTTC
GTGATCGAGTTCATATTGTTTCATTACGTTGAGATCAGACGGTGGCAAGACATCAAGAACCCAGGAAGTGT
GAACCAAGACCCTATCTTTAAGCAATACAGCTTACCTAAGGGTGAAGTTGGTTACCCTGGTGGAATCTTTAA
CCCGCTTAACTTTGCTCCTACGCAAGAGGCCAAGGAGAAAGAGCTAGCAAACGGGAGGTTGGCGATGTTGG
CATTCTTAGGGTTTGTGGTTCAACACAATGTGACTGGAAAAGGACCATTTGAGAATCTGTTGCAGCACTTGT
CTGACCCATGGCACAACACTATTGTCCAAACCTTCAAC
```

Figure 9C:     Amino acid sequence of the open reading frame of pk329AT01

```
MATVTTHASASIFRPCTSKPRFLTGSSGRLNRDLSFTSIGSSAKTSSFKVEAKKGEWLPGLASPDYLTGSLAGDNGFDP
LGLAEDPENLKWFVQAELVNGRWAMLGVAGMLLPEVFTKIGIINVPEWYDAGKEQYFASSSTLFVIEFILFHYVEIRRW
QDIKNPGSVNQDPIFKQYSLPKGEVGYPGGIFNPLNFAPTQEAKEKELANGRLAMLAFLGFVVQHNVTGKGPFENLL
QHLSDPWHNTIVQTFN
```

Figure 10A     - Nucleic acid sequence of pk331AT01

```
ATGAACGCCGCCGTGTTTAGTCCTTCTGCTTTATCTCTCCCTATCTCCTTCTCTAAAACCCGATCCTCTTTTC
TCTCCAGAAAGAAGGGCGTGAAAGGAGAATTTAGGGTATTTGCTGTGTTTGGTGATGAGAGTGGATTAGTT
GAGAAGAAGAGTCAATGGAGACCTTTGTTTGATGTGGAGGATCCTAGATCAAAAGCTCCTCCTTATAAAGG
AAAGTTTTTAGATGTTAATCAAGCTATTGAAGTTGCTAGGTTTGATATTCAATACTTGGATTGGCGTGCTCG
TCAAGATCTTCTTACCATTATGATTCTTCATGACAAGGTTGTTGATGTACTTAATCCTCTAGCTCGTGAGTA
CAAGTCCATCGGTACAGTGAAGAAAGAACTAGCTGGATTGCAGGAAGAATTATCGAAAGCACACCAACAGG
TTCATATATCTGAAGCAAGGGTTTCGACTGCTTTAGACAAGTTAGCCCACATGGAAGAATTGGTTAATGATA
GGTTGTTACCTGGCAGAGTTGTAACGGAATTAGATAAACCCTCCTCTTCAACCACTGCTTCTGCTGTCGAGT
TAGATAGGGAAAAGACAAACACGGGTGCGAAAAGCTTGAATGTTTCTGGTCCGGTTCCGCCTTATAGTCCA
CACTTGAAGAATTTTTGGTATCCCGTTGCTTTCACTGCAGATCTCAAGCATGATACAATGGTACCAATTGAA
TGCTTTGAACAACCATGGGTTATCTTTAGGGGTGAAGACGGGAAACCAGGATGTGTACGGAATACATGTGC
GCATAGAGCATGTCCTCTTGATCTTGGCACAGTGAACGAGGGACGTATTCAATGTCCGTACCATGGATGGG
AATACTCAACCGATGGAGAATGTAAGAAGATGCCGTCTACAAAGTTACTGAAGGTGAAGATCAAATCATTA
CCTTGTCTTGAACAAGAAGGTATGATCTGGATTTGGCCCGGTGATGAGCCACCTGCACCTATACTTCCTTCT
TTACAGCCTCCATCAGGGTTTTTAATTCATGCTGAGCTTGTAATGGACCTCCCGGTGGAACACGGTTTACTT
CTAGATAATCTCTTGGATCTTGCTCATGCCCCATTCACTCATACATCCACTTTTGCAAAAGGCTGGAGTGTC
CCAAGTTTGGTGAAGTTTTTAACACCTACCTCGGGTCTCCAAGGATACTGGGATCCATATCCAATCGATATG
GAATTTAAACCACCGTGTATTGTTTATCGACAATCGGGATATCAAAACCCGGGAAACTAGAAGGCAAAAG
CACACAGCAGTGTGCAACACATCTTCATCAACTCCATGTCTGTTTACCTTCTTCTAAAAACAAGACAAGACT
TCTATACCGAATGTCACTAGACTTTGCTCCTATATTAAAGAATCTTCCATTCATGGAACATCTGTGGAGACA
TTTCGCTGAACAGGTCTTAAACGAAGATCTACGGCTAGTTTTAGGACAACAAGAACGGATGTTAAACGGAG
CAAACATATGGAATTTACCAGTTGCTTATGACAAGCTCGGAGTTCGGTATAGACTATGGAGGAACGCAGTA
GATCGTGGCGATGATAAACTACCTTTCTCCGGCTAA
```

Figure 10B    Nucleic acid sequence of the open reading frame of pk331AT01

ATGAACGCCGCCGTGTTTAGTCCTTCTGCTTTATCTCTCCCTATCTCCTTCTCTAAAACCCGATCCTCTTTTC
TCTCCAGAAAGAAGGGCGTGAAAGGAGAATTTAGGGTATTTGCTGTGTTTGGTGATGAGAGTGGATTAGTT
GAGAAGAAGAGTCAATGGAGACCTTTGTTTGATGTGGAGGATCCTAGATCAAAAGCTCCTCCTTATAAAGG
AAAGTTTTTAGATGTTAATCAAGCTATTGAAGTTGCTAGGTTTGATATTCAATACTTGGATTGGCGTGCTCG
TCAAGATCTTCTTACCATTATGATTCTTCATGACAAGGTTGTTGATGTACTTAATCCTCTAGCTCGTGAGTA
CAAGTCCATCGGTACAGTGAAGAAAGAACTAGCTGGATTGCAGGAAGAATTATCGAAAGCACACCAACAGG
TTCATATATCTGAAGCAAGGGTTTCGACTGCTTTAGACAAGTTAGCCCACATGGAAGAATTGGTTAATGATA
GGTTGTTACCTGGCAGAGTTGTAACGGAATTAGATAAACCCTCCTCTTCAACCACTGCTTCTGCTGTCGAGT
TAGATAGGGAAAAGACAAACACGGGTGCGAAAAGCTTGAATGTTTCTGGTCCGGTTCCGCCTTATAGTCCA
CACTTGAAGAATTTTTGGTATCCCGTTGCTTTCACTGCAGATCTCAAGCATGATACAATGGTACCAATTGAA
TGCTTTGAACAACCATGGGTTATCTTTAGGGGTGAAGACGGGAAACCAGGATGTGTACGGAATACATGTGC
GCATAGAGCATGTCCTCTTGATCTTGGCACAGTGAACGAGGGACGTATTCAATGTCCGTACCATGGATGGG
AATACTCAACCGATGGAGAATGTAAGAAGATGCCGTCTACAAAGTTACTGAAGGTGAAGATCAAATCATTA
CCTTGTCTTGAACAAGAAGGTATGATCTGGATTTGGCCCGGTGATGAGCCACCTGCACCTATACTTCCTTCT
TTACAGCCTCCATCAGGGTTTTTAATTCATGCTGAGCTTGTAATGGACCTCCCGGTGGAACACGGTTTACTT
CTAGATAATCTCTTGGATCTTGCTCATGCCCCATTCACTCATACATCCACTTTTGCAAAAGGCTGGAGTGTC
CCAAGTTTGGTGAAGTTTTTAACACCTACCTCGGGTCTCCAAGGATACTGGGATCCATATCCAATCGATATG
GAATTTAAACCACCGTGTATTGTTTATCGACAATCGGGATATCAAAACCCGGGAAACTAGAAGGCAAAAG
CACACAGCAGTGTGCAACACATCTTCATCAACTCCATGTCTGTTTACCTTCTTCTAAAAACAAGACAAGACT
TCTATACCGAATGTCACTAGACTTTGCTCCTATATTAAAGAATCTTCCATTCATGGAACATCTGTGGAGACA
TTTCGCTGAACAGGTCTTAAACGAAGATCTACGGCTAGTTTTAGGACAACAAGAACGGATGTTAAACGGAG
CAAACATATGGAATTTACCAGTTGCTTATGACAAGCTCGGAGTTCGGTATAGACTATGGAGGAACGCAGTA
GATCGTGGCGATGATAAACTACCTTTCTCCGGC

Figure 10C    Amino acid sequence of the open reading frame of pk331AT01

MNAAVFSPSALSLPISFSKTRSSFLSRKKGVKGEFRVFAVFGDESGLVEKKSQWRPLFDVEDPRSKAPPYKGKFLDVNQ
AIEVARFDIQYLDWRARQDLLTIMILHDKVVDVLNPLAREYKSIGTVKKELAGLQEELSKAHQQVHISEARVSTALDKL
AHMEELVNDRLLPGRVVTELDKPSSSTTASAVELDREKTNTGAKSLNVSGPVPPYSPHLKNFWYPVAFTADLKHDTM
VPIECFEQPWVIFRGEDGKPGCVRNTCAHRACPLDLGTVNEGRIQCPYHGWEYSTDGECKKMPSTKLLKVKIKSLPCL
EQEGMIWIWPGDEPPAPILPSLQPPSGFLIHAELVMDLPVEHGLLLDNLLDLAHAPFTHTSTFAKGWSVPSLVKFLTPTS
GLQGYWDPYPIDMEFKPPCIVLSTIGISKPGKLEGKSTQQCATHLHQLHVCLPSSKNKTRLLYRMSLDFAPILKNLPFM
EHLWRHFAEQVLNEDLRLVLGQQERMLNGANIWNLPVAYDKLGVRYRLWRNAVDRGDDKLPFSG

Figure 11A              Nucleic acid sequence of pk331Gm59746258

```
TCTCTTTCTCTCTTCAGACAGAGACTGTCAGCTTCGCCCCGCCATGAACGCTATTGCAACTGCTGCAGTTCT
CTCTCTCCCTTTCTCCTTCTCCAAATCATCCAAACTTGACACCAAAAAGGGTTTAAAAGGAAGGTTTAGAGT
GTTTGCTGTATATGGAGAAGAGATAGATAAGAAGAATGCATGGAGTGCCCTCTTTGATGTGGAGGATCCAC
GATCTAAAGTGCCGCAGTATAAAGGGAAGTTTTTGGATGTATATCAAGCCCTTGAAGTTGCAAGATATGATA
TTCAATACTGTGATTGGCGAGCTAGGCAAGACTTGCTTACCATCATGCTTCTTCATGAAAAGGTGGTGGAG
GTTCTTAATCCTTTAGCTCGTGATTATAAGTCCATTGGCACCATGAAAAAGGAGCTAGCAGAGTTGCAGGA
AGAATTGGCACAAGCACACCAACAGGTTCATATATCTGAGGCAAGGGTGTCCACTGCTTTAGATAAACTAG
CTTACATGGAAGAATTAGTAAACGATAAGTTGTTGCAAGAAAGAACCACAACCGAAGTTTCCCAGACATCC
TCTTCTCCCAGTACTTCTTTTAAACCTGTAGATGTAGAAAAGAGAAGACCGCCACGAAAAAGCTTGGACAT
ATCAGGTCCAGTTCAGTCATACCATACCCACTTGAAGAATTTCTGGTACCCTGTAGCTTTCTCTAATGACTT
GAAGGATGATACAATGATCCCAATAGAATGTTTTGAGGAACCATGGGTCATCTTCCGAGGGAAAGATGGGA
AGCCTGGGTGTGTTCAGAACACCTGTGCACACAGAGCATGTCCTCTACACCTTGGTTCGGTAAATGAGGGT
CGTATCCAATGCCCTTACCATGGCTGGGAATATACTACTGATGGAAAATGTGAGAAAATGCCATCTACTCG
ACAGCTAAATGTGAAAATAAAGTCATTGCCATGCTTTGAAACAGAGGGGATGATCTGGGTTTGGCCTGGCA
ATGACCCCCCGACGGCTACCCTTCCATCTTTGCTACCTCCTTCTGGGTTTGAAGTGCATGCTGAGATTGTCA
TGGAACTTCCAATTGAACACGGGTTACTTTTGGACAACCTTTTGGATCTTGCACATGCCCCTTTTACTCACA
CTTCAACTTTTGCTAAGGGATGGAGTGTTCCCAGCTTGGTGAAATTTTTGACACCTGCATCTGGCCTACAAG
GATACTGGGACCCCTATCCAATTGATATGGAGTTTCGGCCACCTTGCATGGTTCTATCAACCATTGGAATTT
CGAAGCCTGGTAAACTGGAAGGACAAAGCACCAGTCAGTGTGCCACACACCTGCACCAACTTCATGTCTGC
TTACCATCTTCAAAACAAAAAACAAGATTGCTGTACAGAATGTCACTGGATTTTGCTCCTGTGCTTAAGCAT
ATTCCTTTTATGCAACATCTATGGAGATATTTTGCAGAGCAGGTTTTAAACGAGGATCTACGGCTAGTGTTA
GGCCAGCAAGAGCGGATGAACAATGGTGCCAATGTGTGGAATTTCCCAGTATCCTATGACAAGCTTGGGAT
AAGGTACAGACTATGGAGAAATGCCTTGGAGCGAGGAAATAAGCAACCACCCTTCAGCAAATAGACTTGAA
TAAAGATTACAGTACTTTTTATCTTAGTCTTGGAACCAACTTTGATTAACTAAAAGCCACTCAGGCACCCTT
GCAATAGAAAGGCCAATCCACACGTTGCCTTTCGTTGGTTCTTCAGTGCATTCATGCGGAGGAAACTAAA
AAATTTGATCAGAGGCTGTCTCCTCTTATTCAAGCCCCTTGTAAAAATAGCACCCACTGTACACTTAGCTTT
TATTATTTCTGTGTACAGGATCAAGTTCATTTTTTACCCCACTTTTGCCATCTCAACTGGTGGCTTAACCTCG
CGCCATAAAACTGGCGTTTCTTGTATTATGACATTACCATCTTAGCTCAATGAAAATTTGATAATTCAGAAT
TCGTGACAAAAAAAAAAAAAAAAA
```

Figure 11B        Nucleic acid sequence of the open reading frame of
pk331Gm59746258

ATGAACGCTATTGCAACTGCTGCAGTTCTCTCTCTCCCTTTCTCCTTCTCCAAATCATCCAAACTTGACACC
AAAAAGGGTTTAAAAGGAAGGTTTAGAGTGTTTGCTGTATATGGAGAAGAGATAGATAAGAAGAATGCATG
GAGTGCCCTCTTTGATGTGGAGGATCCACGATCTAAAGTGCCGCAGTATAAAGGGAAGTTTTTGGATGTAT
ATCAAGCCCTTGAAGTTGCAAGATATGATATTCAATACTGTGATTGGCGAGCTAGGCAAGACTTGCTTACCA
TCATGCTTCTTCATGAAAAGGTGGTGGAGGTTCTTAATCCTTTAGCTCGTGATTATAAGTCCATTGGCACCA
TGAAAAAGGAGCTAGCAGAGTTGCAGGAAGAATTGGCACAAGCACACCAACAGGTTCATATATCTGAGGCA
AGGGTGTCCACTGCTTTAGATAAACTAGCTTACATGGAAGAATTAGTAAACGATAAGTTGTTGCAAGAAAG
AACCACAACCGAAGTTTCCCAGACATCCTCTTCTCCCAGTACTTCTTTTAAACCTGTAGATGTAGAAAAGAG
AAGACCGCCACGAAAAAGCTTGGACATATCAGGTCCAGTTCAGTCATACCATACCCACTTGAAGAATTTCT
GGTACCCTGTAGCTTTCTCTAATGACTTGAAGGATGATACAATGATCCCAATAGAATGTTTTGAGGAACCAT
GGGTCATCTTCCGAGGGAAAGATGGGAAGCCTGGGTGTGTTCAGAACACCTGTGCACACAGAGCATGTCCT
CTACACCTTGGTTCGGTAAATGAGGGTCGTATCCAATGCCCTTACCATGGCTGGGAATATACTACTGATGG
AAAATGTGAGAAAATGCCATCTACTCGACAGCTAAATGTGAAAATAAAGTCATTGCCATGCTTTGAAACAG
AGGGGATGATCTGGGTTTGGCCTGGCAATGACCCCCCGACGGCTACCCTTCCATCTTTGCTACCTCCTTCT
GGGTTTGAAGTGCATGCTGAGATTGTCATGGAACTTCCAATTGAACACGGGTTACTTTTGGACAACCTTTTG
GATCTTGCACATGCCCCTTTTACTCACACTTCAACTTTTGCTAAGGGATGGAGTGTTCCCAGCTTGGTGAAA
TTTTTGACACCTGCATCTGGCCTACAAGGATACTGGGACCCCTATCCAATTGATATGGAGTTTCGGCCACCT
TGCATGGTTCTATCAACCATTGGAATTTCGAAGCCTGGTAAACTGGAAGGACAAAGCACCAGTCAGTGTGC
CACACACCTGCACCAACTTCATGTCTGCTTACCATCTTCAAAACAAAAAACAAGATTGCTGTACAGAATGTC
ACTGGATTTTGCTCCTGTGCTTAAGCATATTCCTTTTATGCAACATCTATGGAGATATTTTGCAGAGCAGGT
TTTAAACGAGGATCTACGGCTAGTGTTAGGCCAGCAAGAGCGGATGAACAATGGTGCCAATGTGTGGAATT
TCCCAGTATCCTATGACAAGCTTGGGATAAGGTACAGACTATGGAGAAATGCCTTGGAGCGAGGAAATAAG
CAACCACCCTTCAGCAAA

Figure 11C        Amino acid sequence of the open reading frame of
pk331Gm59746258

MNAIATAAVLSLPFSFSKSSKLDTKKGLKGRFRVFAVYGEEIDKKNAWSALFDVEDPRSKVPQYKGKFLDVYQALEVA
RYDIQYCDWRARQDLLTIMLLHEKVVEVLN?? ???YKSIGTMKKELAELQEELAQAHQQVHISEARVSTALDKLAYM
EELVNDKLLQERTTTEVSQTSSSPSTSFKPVDVEKRRPPRKSLDISGPVQSYHTHLKNFWYPVAFSNDLKDDTMIPIECF
EEPWVIFRGKDGKPGCVQNTCAHRACPLHLGSVNEGRIQCPYHGWEYTTDGKCEKMPSTRQLNVKIKSLPCFETEG
MIWVWPGNDPPTATLPSLLPPSGFEVHAEIVMELPIEHGLLLDNLLDLAHAPFTHTSTFAKGWSVPSLVKFLTPASGLQ
GYWDPYPIDMEFRPPCMVLSTIGISKPGKLEGQSTSQCATHLHQLHVCLPSSKQKTRLLYRMSLDFAPVLKHIPFMQH
LWRYFAEQVLNEDLRLVLGQQERMNNGANVWNFPVSYDKLGIRYRLWRNALERGNKQPPFSK

Figure 12A        Nucleic acid sequence of pk33lOS37l09650

CCTCTGGTTGAGGAAAAATATGGGGAGTATTTGTGCGTTTTTATTTTTGTTTTTGGGTCGCACTGTTCGATC
GTAGCATCCATGACCACTGTGGCATCGCTGTCTTTGCTGCCGCACTTGCTCATCAAGCCTTCCTTCAGGTGT
TGCTCCAGAAAGGGTGTTGGTAGATATGGAGGAATCAAGGTGTATGCGGTGCTCGGTGATGATGGAGCTGA
CTATGCAAAGAACAACGCATGGGAGGCCTTGTTCCATGTCGATGACCCGGGGCCAAGGGTTCCAATTGCAA
AAGGCAAGTTCTTGGATGTCAACCAAGCTCTTGAGGTGGTCCGGTTCGATATCCAGTATTGCGATTGGAGG
GCGCGGCAGGACCTCCTCACCATCATGGTTCTTCACAACAAGGTGGTAGAGGTTCTTAATCCTTTAGCAAG
GGAGTTCAAGTCAATTGGAACCTTGAGGAAAGAGCTTGCAGAATTACAGGAAGAATTGGCAAAAGCTCACA
ATCAGGTTCATCTGTCGGAAACTAGAGTATCATCTGCCCTTGATAAGTTGGCACAAATGGAGACCCTTGTCA
ACGACAGACTGTTGCAAGATGGAGGCTCTAGCGCATCTACAGCCGAGTGCACTTCCCTTGCTCCAAGCACG
TCATCAGCGTCCCGTGTTGTAAACAAGAAACCTCCTCGCCGGAGTCTGAACGTGTCTGGTCCAGTGCAGCC
ATACAATCCCAGTCTGAAGAACTTCTGGTACCCAGTTGCTTTCTCCAGTGACCTAAAAGACGATACAATGGT
GCCAATAGATTGTTTTGAGGAGCAGTGGGTAATTTTCCGAGGAAAGGATGGGAGACCTGGATGTGTTATGA
ACACATGTGCTCACAGAGCTTGCCCTCTTCATCTTGGCTCAGTTAATGAGGGCAGAATCCAATGCCCTTACC
ATGGTTGGGAGTATTCAACTGATGGAAAATGTGAGAAAATGCCATCCACAAAGATGCTCAACGTGCGCATC
CGGTCATTACCATGCTTTGAGCAAGAAGGAATGGTTTGGATATGGCCTGGCAATGACCCACCGAAGTCGAC
TATCCCTTCTCTGCTGCCTCCTTCAGGATTTACAATTCACGCAGAGATAGTGATGGAGCTACCAGTGGAGCA
TGGACTTCTTCTGGACAATCTATTAGATCTTGCTCATGCTCCTTTTACTCATACATCCACCTTTGCCAAGGG
TTGGAGTGTTCCAAGCTTGGTGAAGTTCTTGACACCTTCATCTGGGCTTCAAGGATACTGGGATCCATACCC
GATCGACATGGAATTTCGACCACCATGCATGGTGTTGTCAACCATTGGCATCTCAAAGCCTGGAAAACTAG
AGGGGAAGAGCACCAAGCAATGTTCGACGCATCTCCACCAGCTCCATATCTGTTTGCCCTCCTCTAGGAAT
AAAACCAGGCTGCTCTACCGGATGTCTCTCGACTTCGCTCCATGGATCAAGCATGTCCCTTTCATGCATATA
CTATGGTCACATTTTGCTGAGAAGGTCTTGAATGAGGATCTTCGACTCGTGCTCGGGCAGCAAGAACGGAT
GATCAATGGCGCAAATGTCTGGAACTGGCCAGTATCATATGACAAGCTTGGTATCCGGTATCGGTTGTGGA
GAGACGCCATTGAGAGGGGAGTAGACAGGTTGCCATTCAGTAACCAAAGTGAGAGTGGATCATAGTAGCTG
CATTGCCAATAGCCTCTTTTCAATTCTTGTCGTATTTCTTGGCGAGATGAAGATGAAGATGAAGATGATGAT
GGCCAGAACTAGTCAGTGGATGTATATGCACAGTTTGTTTAGGCGTGCGTCCCTGCATGGTTGGTTCACCA
TCTCCCTGAGCTTCGTTGCAGATTGAATTGGGTTCTGGAGAGGAAAGGCTAATGGAAGGAGAGAATGATAG
GCGACGTCATTCTGTGTAATTTTAAGTGTACACTAGCGACAGCATCACGGGATGCAATTGTAATCTGAGGTT
GATTTGTTTTTCTTCTTTTTTTTTTCCTCCCCTTTTACCCATGTAAAAGTCGATCGCATGTCACGCTATGATG
CATATATATGATCATACTATTGATTATTGAGCCATGAAAAAAAAGAAAAAAAAACTCGAGGGGGGCCCG
GTACCCAGCTTTGTCTAAACGTCACATTCCATTCCCATTCTGCTTATCTATTTGGCAGATTCTGTGTATGGT
TTGCTAATTCAGAACAGTAAGGTCTCTTGATAAGTTGAGACA

Figure 12B     Nucleic acid sequence of the open reading frame of pk331OS37109650

```
ATGACCACTGTGGCATCGCTGTCTTTGCTGCCGCACTTGCTCATCAAGCCTTCCTTCAGGTGTTGCTCCAGA
AAGGGTGTTGGTAGATATGGAGGAATCAAGGTGTATGCGGTGCTCGGTGATGATGGAGCTGACTATGCAAA
GAACAACGCATGGGAGGCCTTGTTCCATGTCGATGACCCGGGGCCAAGGGTTCCAATTGCAAAAGGCAAGT
TCTTGGATGTCAACCAAGCTCTTGAGGTGGTCCGGTTCGATATCCAGTATTGCGATTGGAGGGCGCGGCAG
GACCTCCTCACCATCATGGTTCTTCACAACAAGGTGGTAGAGGTTCTTAATCCTTTAGCAAGGGAGTTCAAG
TCAATTGGAACCTTGAGGAAAGAGCTTGCAGAATTACAGGAAGAATTGGCAAAAGCTCACAATCAGGTTCA
TCTGTCGGAAACTAGAGTATCATCTGCCCTTGATAAGTTGGCACAAATGGAGACCCTTGTCAACGACAGAC
TGTTGCAAGATGGAGGCTCTAGCGCATCTACAGCCGAGTGCACTTCCCTTGCTCCAAGCACGTCATCAGCG
TCCCGTGTTGTAAACAAGAAACCTCCTCGCCGGAGTCTGAACGTGTCTGGTCCAGTGCAGCCATACAATCC
CAGTCTGAAGAACTTCTGGTACCCAGTTGCTTTCTCCAGTGACCTAAAAGACGATACAATGGTGCCAATAG
ATTGTTTTGAGGAGCAGTGGGTAATTTTCCGAGGAAAGGATGGGAGACCTGGATGTGTTATGAACACATGT
GCTCACAGAGCTTGCCCTCTTCATCTTGGCTCAGTTAATGAGGGCAGAATCCAATGCCCTTACCATGGTTG
GGAGTATTCAACTGATGGAAAATGTGAGAAAATGCCATCCACAAAGATGCTCAACGTGCGCATCCGGTCAT
TACCATGCTTTGAGCAAGAAGGAATGGTTTGGATATGGCCTGGCAATGACCCACCGAAGTCGACTATCCCT
TCTCTGCTGCCTCCTTCAGGATTTACAATTCACGCAGAGATAGTGATGGAGCTACCAGTGGAGCATGGACT
TCTTCTGGACAATCTATTAGATCTTGCTCATGCTCCTTTTACTCATACATCCACCTTTGCCAAGGGTTGGAG
TGTTCCAAGCTTGGTGAAGTTCTTGACACCTTCATCTGGGCTTCAAGGATACTGGGATCCATACCCGATCGA
CATGGAATTTCGACCACCATGCATGGTGTTGTCAACCATTGGCATCTCAAAGCCTGGAAAACTAGAGGGGA
AGAGCACCAAGCAATGTTCGACGCATCTCCACCAGCTCCATATCTGTTTGCCCTCCTCTAGGAATAAAACC
AGGCTGCTCTACCGGATGTCTCTCGACTTCGCTCCATGGATCAAGCATGTCCCTTTCATGCATATACTATGG
TCACATTTTGCTGAGAAGGTCTTGAATGAGGATCTTCGACTCGTGCTCGGGCAGCAAGAACGGATGATCAA
TGGCGCAAATGTCTGGAACTGGCCAGTATCATATGACAAGCTTGGTATCCGGTATCGGTTGTGGAGAGACG
CCATTGAGAGGGGAGTAGACAGGTTGCCATTCAGTAACCAAAGTGAGAGTGGATCA
```

Figure 12C     Amino acid sequence of the open reading frame of pk331OS37109650

```
MTTVASLSLLPHLLIKPSFRCCSRKGVGRYGGIKVYAVLGDDGADYAKNNAWEALFHVDDPGPRVPIAKGKFLDVNQ
ALEVVRFDIQYCDWRARQDLLTIMVLHNKVVEVLNPLAREFKSIGTLRKELAELQEELAKAHNQVHLSETRVSSALDK
LAQMETLVNDRLLQDGGSSASTAECTSLAPSTSSASRVVNKKPPRRSLNVSGPVQPYNPSLKNFWYPVAFSSDLKDD
TMVPIDCFEEQWVIFRGKDGRPGCVMNTCAHRACPLHLGSVNEGRIQCPYHGWEYSTDGKCEKMPSTKMLNVRIRS
LPCFEQEGMVWIWPGNDPPKSTIPSLLPPSGFTIHAEIVMELPVEHGLLLDNLLDLAHAPFTHTSTFAKGWSVPSLVKFL
TPSSGLQGYWDPYPIDMEFRPPCMVLSTIGISKPGKLEGKSTKQCSTHLHQLHICLPSSRNKTRLLYRMSLDFAPWIKH
VPFMHILWSHFAEKVLNEDLRLVLGQQERMINGANVWNWPVSYDKLGIRYRLWRDAIERGVDRLPFSNQSESGS
```

Figure 13A        Nucleic acid sequence of pk320AT01

GTTCTTACAAAACAGAACCAAACTTCGACAATGTCACTCATGTTTTCTTCCCCTGTCGTCACCCCAGCACTC
GGATCTTTCACCTTCTCATCTCGACCACGCTCCAATTACATCGTGATGTCCGCCGTCCGATCTAACTCTGCT
TCGACGTGTCCTATACTGACCAAGTTTCAGAAAGACTGCGCCACTCCTACACCGTACCTACGCAACGTAGC
CAACGCCATTGCTGATGACATGCGAGATGGTCTAGCTGTTGAAGGAGGAGGAGATCTCGAGATGATCTTGA
CTTTTGTTGACGCTTTGCCTTCTGGGAATGAGGAAGGGTTGTTCTATGCATTGGATTTAGGAGGTACAAATT
TTCGGGTGCGTAGCGTGCAATTAGGAGGAAAGAAAGAGCGAGTCTTAGCTACCGAATCTGAACAAATATCT
ATTTCTCAAAAGCTTATGATTGGTACAAGTGAGGAGCTTTTCGGGTTCATTGCTTCAAAGCTTGCAAATTTT
GTTGCAAAGGAGAAGCCAGGTCGGTTTCTTTTAGAAGAAGGGAGGAAAAGGGAGTTAGGGTTTACCTTTTC
ATTCCCTGTGAAGCAAACCTCTATTGATTCAGGCACATTAAGCAAGTGGACTAAAGGCTTTAAAGTGTCTGG
AATGGAAGGAAAAAATGTGGTTGCTTGTTTAAATGAAGCTATGGAAGCACATGGACTCGATATGCGAGTTT
CTGCTCTTGTAAATGATGGAGTGGGAACATTAGCTGGAGCAAGGTATTGGGATGAGGATGTGATGGTCGGT
GTGATTCTTGGCACTGGGACCAATGCTTGTTATGTAGAACAGAAACATGCAATTCCTAAACTCCGAAGCAA
ATCTTCTTCTGGAACAACGATCATAAACACTGAGTGGGGAGGGTTCTCTAAGATTCTTCCGCAAACCATTTT
TGACCTAGAGATGGATGAGACAAGCCTGAATCCTGGTGAACATTTATATGAGAAGATGATCTCAGGGATGT
ACCTTGGTGAAATTGTAAGGAGGGTTTTGCTCCATATGTGTGAAACTAGTGACTTGTTTGGACACTTCGCTC
CTGCCAAACTCTCCACTCCTTTGGCACTCAGGACCGAGCATCTATGCAAAATGCAAGAGGACAATACAGAT
GATCTTCGGGATGTTGGATCAATCCTATACGACTTTTTTAGATGTAGAGGCGAATATGAATGCAAGGAGGAG
AGTGGTGGAAGTGTGTGACACAGTAGTGAAACGCGGAGGGCGTCTAGCAGGAGCTGGTATAGTGGCAATTC
TGGAGAAGATTGAAAAAGATACCAAAAGAATGGGTTCAGGTAAAAGAACCGTTGTGGCTATGGACGGTGCA
CTGTATGAGAAGTACCCACAATATCGACAGTATATGCAAGACGCACTAGTCGAGCTTCTTGGCCATAAGCT
TGCAAGTCACGTTGCGATCAAACATACCAAAGACGTGTCTGGGCTCGGTGCTGCTCTTTTGGCGGCCACTA
ACTCCATTTACTAGTACTTGGACCTCTACTTCATGAGTATAGGAGGACTTTTGGTCCATTTGTTTGTGTACA
TTTATATAAGATATCATATCAATATCAATAAGATTGTAAAGAGGAGCAACGAACTAGCAGAAGATTATGTCT
TGGACC

Figure 13B    Nucleic acid sequence of the open reading frame of pk320AT01

ATGTCACTCATGTTTTCTTCCCCTGTCGTCACCCCAGCACTCGGATCTTTCACCTTCTCATCTCGACCACGC
TCCAATTACATCGTGATGTCCGCCGTCCGATCTAACTCTGCTTCGACGTGTCCTATACTGACCAAGTTTCAG
AAAGACTGCGCCACTCCTACACCGTACCTACGCAACGTAGCCAACGCCATTGCTGATGACATGCGAGATGG
TCTAGCTGTTGAAGGAGGAGGAGATCTCGAGATGATCTTGACTTTTGTTGACGCTTTGCCTTCTGGGAATGA
GGAAGGGTTGTTCTATGCATTGGATTTAGGAGGTACAAATTTTCGGGTGCGTAGCGTGCAATTAGGAGGAA
AGAAAGAGCGAGTCTTAGCTACCGAATCTGAACAAATATCTATTTCTCAAAAGCTTATGATTGGTACAAGTG
AGGAGCTTTTCGGGTTCATTGCTTCAAAGCTTGCAAATTTTGTTGCAAAGGAGAAGCCAGGTCGGTTTCTTT
TAGAAGAAGGGAGGAAAAGGGAGTTAGGGTTTACCTTTTCATTCCCTGTGAAGCAAACCTCTATTGATTCA
GGCACATTAAGCAAGTGGACTAAAGGCTTTAAAGTGTCTGGAATGGAAGGAAAAAATGTGGTTGCTTGTTT
AAATGAAGCTATGGAAGCACATGGACTCGATATGCGAGTTTCTGCTCTTGTAAATGATGGAGTGGGAACAT
TAGCTGGAGCAAGGTATTGGGATGAGGATGTGATGGTCGGTGTGATTCTTGGCACTGGGACCAATGCTTGT
TATGTAGAACAGAAACATGCAATTCCTAAACTCCGAAGCAAATCTTCTTCTGGAACAACGATCATAAACACT
GAGTGGGGAGGGTTCTCTAAGATTCTTCCGCAAACCATTTTTGACCTAGAGATGGATGAGACAAGCCTGAA
TCCTGGTGAACATTTATATGAAGATGATCTCAGGGATGTACCTTGGTGAAATTGTAAGGAGGGTTTTGCT
CCATATGTGTGAAACTAGTGACTTGTTTGGACACTTCGCTCCTGCCAAACTCTCCACTCCTTTGGCACTCAG
GACCGAGCATCTATGCAAAATGCAAGAGGACAATACAGATGATCTTCGGGATGTTGGATCAATCCTATACG
ACTTTTTAGATGTAGAGGCGAATATGAATGCAAGGAGGAGAGTGGTGGAAGTGTGTGACACAGTAGTGAAA
CGCGGAGGGCGTCTAGCAGGAGCTGGTATAGTGGCAATTCTGGAGAAGATTGAAAAAGATACCAAAAGAAT
GGGTTCAGGTAAAAGAACCGTTGTGGCTATGGACGGTGCACTGTATGAAGTACCCACAATATCGACAGT
ATATGCAAGACGCACTAGTCGAGCTTCTTGGCCATAAGCTTGCAAGTCACGTTGCGATCAAACATACCAAA
GACGTGTCTGGGCTCGGTGCTGCTCTTTTGGCGGCCACTAACTCCATTTAC

Figure 13C    Amino acid sequence of the open reading frame of pk320AT01

MSLMFSSPVVTPALGSFTFSSRPRSNYIVMSAVRSNSASTCPILTKFQKDCATPTPYLRNVANAIADDMRDGLAVEGG
GDLEMILTFVDALPSGNEEGLFYALDLGGTNFRVRSVQLGGKKERVLATESEQISISQKLMIGTSEELFGFIASKLANFV
AKEKPGRFLLEEGRKRELGFTFSFPVKQTSIDSGTLSKWTKGFKVSGMEGKNVVACLNEAMEAHGLDMRVSALVND
GVGTLAGARYWDEDVMVGVILGTGTNACYVEQKHAIPKLRSKSSSGTTIINTEWGGFSKILPQTIFDLEMDETSLNPG
EHLYEKMISGMYLGEIVRRVLLHMCETSDLFGHFAPAKLSTPLALRTEHLCKMQEDNTDDLRDVGSILYDFLDVEAN
MNARRRVVEVCDTVVKRGGRLAGAGIVAILEKIEKDTKRMGSGKRTVVAMDGALYEKYPQYRQYMQDALVELLGH
KLASHVAIKHTKDVSGLGAALLAATNSIY

Figure 14A      Nucleic acid sequence of pk320BN51431102

CCACCACGAGCTCGAGTAGATCGATCTAGGGTTCCCATTAATTTCGGTATTTTTAGATCCAACCCAATCCTA
TAATAGATCCTTTTTGACCTTTGTCCTTTTTGTCTTACAGATCGAATCTTATGGGTAAAGTGGCTGTTGGTG
CGACGGTCGTGTGCGCTGCGGCGGTCTGCGCGGCGTCTGTGTACATCGTGCGGCGGCGGATGCAAAGCTC
CGGGAAATGGGCGCGTGTGATAGAGATCCTGAGGGTTCTCGAGGAGGATTGCGCGACGCCTATCGCGAAA
CTGAGACAAGTGGCGGATGCGATGACGGTTGAGATGCACGCGGGTCTCGCTTCCGAAGGTGGAAGCAAGC
TTAAGATGCTTATCAGCTACGTCGATAATCTTCCCTCTGGGGAAGAACATGGTTTCTTCTATGCGCTGGACC
TAGGAGGAACGAACTTCCGTGTGATGCGTGTGCTTCTTGGTGGCAAACAAGGCCGTGTTGTCAAACAAGAA
GCCAAAGAAGTCTCTATTCCTCCTCATTTGATGACCAGCGGTTCAGATGAACTGTTCAATTTTATCGCTGAG
GCGCTTGCAAATTTCGTGGCTACAGAAGGAGAGGACTTTCATCTCCCTGAGGGTAGACAAAGGGAGCTAGG
TTTCACTTTCTCGTTTCCGGTTAAGCAGACTTCTTTGTCTTCTGGCACTCTCATCAAGTGGACCAAAGGCTT
TTCCATCGAAGATACAGTTGGACAAGATGTGGTTGGTGAGCTTGTTAAAGCTATGGAAAGAGTTGGGCTTG
ACATGAACGTCACAGCCCTTGTTAATGACACGGTTGGAACACTTGCTGGTGGTAGATACTATAACCCTGAT
GTGGTTGCCGCTGTTATCTTAGGCACTGGCACAAACGCAGCTTATGTGGAACGTGCACATGCCATTCCCAA
ATGGCACGGCTTACTTCCCAAATCTGGAGAAATGGTGATCAACATGGAGTGGGGAAACTTCAGGTCATCAC
ATCTTCCCTTGACGGAGTACGACCACTTGCTGGATTTCGATAGTCTGAATCCTGGTGAACAGATTCTTGAGA
AAATCATTTCCGGTATGTATTTGGGAGAGATCTTGCGTAGAGTTCTTCTGAAGATGGCTGAAGAGGCTGCTT
TCTTTGGCGACTCCATCCCACCTAAGCTGAAAGTACCATTCATCATAAGGACTCCGACCATGTCTGCTATGC
ACAGCGACACTTCTCCGGATTTGAAGGTTGTTGGAAGCAAGTTAAAGGACATACTGGAGGTCCCTACTACT
CTGAAGATGAGAAAAGTTGTGATCAGTCTCTGTAACATCATCGCCACCCGAGGAGCTCGTCTCTCTGCAGC
TGGGATCTACGGAATCCTCAAGAAACTAGGAAGAGACGCACCGAAAGATGGAGAAACAACGCAGAAATCT
GTGATTGCCATGGACGGTGGACTGTTCGAGCACTACACTCAGTTCAGTGAGTGTATGGAGAGCTCATTGAA
AGAGTTGCTTGGAGATGAAGCATCAGAGAGCGTCGAGGTGATTCATTCGAATGACGGGTCCGGCGTTGGCG
CTGCATTGCTCGCTGCCTCGCACTTTCAGTACCTCGAGGACTTTGAAACAAGTTTAATTTAAAAGAAGGTTT
CGGCTTCCCAGCATGGAAGGTAAAAAGACCTTTGTGATTTTTTGTTTGCCCATTATTGAGGTTTTTCTTTTTT
TTTTTGTTATCATTGTTCAGGAACAATAATAAACAACCAACCTGGATATCTTCTTCAGGTTATGGCAAATTC
AAAAACAAGCCAATGTTGTAGAACTATATATTTCATAGTTCTATATACGGGATCGTCGACC

Figure 14B     Nucleic acid sequence of the open reading frame of pk32OBN51431102

ATGGGTAAAGTGGCTGTTGGTGCGACGGTCGTGTGCGCTGCGGCGGTCTGCGCGGCGTCTGTGTACATCGT
GCGGCGGCGGATGCAAAGCTCCGGGAAATGGGCGCGTGTGATAGAGATCCTGAGGGTTCTCGAGGAGGAT
TGCGCGACGCCTATCGCGAAACTGAGACAAGTGGCCGGATGCGATGACGGTTGAGATGCACGCGGGTCTCG
CTTCCGAAGGTGGAAGCAAGCTTAAGATGCTTATCAGCTACGTCGATAATCTTCCCTCTGGGGAAGAACAT
GGTTTCTTCTATGCGCTGGACCTAGGAGGAACGAACTTCCGTGTGATGCGTGTGCTTCTTGGTGGCAAACA
AGGCCGTGTTGTCAAACAAGAAGCCAAAGAAGTCTCTATTCCTCCTCATTTGATGACCAGCGGTTCAGATG
AACTGTTCAATTTTATCGCTGAGGCGCTTGCAAATTTCGTGGCTACAGAAGGAGAGGACTTTCATCTCCCTG
AGGGTAGACAAAGGGAGCTAGGTTTCACTTTCTCGTTTCCGGTTAAGCAGACTTCTTTGTCTTCTGGCACTC
TCATCAAGTGGACCAAAGGCTTTTCCATCGAAGATACAGTTGGACAAGATGTGGTTGGTGAGCTTGTTAAA
GCTATGGAAAGAGTTGGGCTTGACATGAACGTCACAGCCCTTGTTAATGACACGGTTGGAACACTTGCTGG
TGGTAGATACTATAACCCTGATGTGGTTGCCGCTGTTATCTTAGGCACTGGCACAAACGCAGCTTATGTGG
AACGTGCACATGCCATTCCCAAATGGCACGGCTTACTTCCCAAATCTGGAGAAATGGTGATCAACATGGAG
TGGGGAAACTTCAGGTCATCACATCTTCCCTTGACGGAGTACGACCACTTGCTGGATTTCGATAGTCTGAAT
CCTGGTGAACAGATTCTTGAGAAAATCATTTCCGGTATGTATTTGGGAGAGATCTTGCGTAGAGTTCTTCTG
AAGATGGCTGAAGAGGCTGCTTTCTTTGGCGACTCCATCCCACCTAAGCTGAAAGTACCATTCATCATAAG
GACTCCGACCATGTCTGCTATGCACAGCGACACTTCTCCGGATTTGAAGGTTGTTGGAAGCAAGTTAAAGG
ACATACTGGAGGTCCCTACTACTCTGAAGATGAGAAAAGTTGTGATCAGTCTCTGTAACATCATCGCCACC
CGAGGAGCTCGTCTCTCTGCAGCTGGGATCTACGGAATCCTCAAGAAACTAGGAAGAGACGCACCGAAAGA
TGGAGAAACAACGCAGAAATCTGTGATTGCCATGGACGGTGGACTGTTCGAGCACTACACTCAGTTCAGTG
AGTGTATGGAGAGCTCATTGAAAGAGTTGCTTGGAGATGAAGCATCAGAGAGCGTCGAGGTGATTCATTCG
AATGACGGGTCCGGCGTTGGCGCTGCATTGCTCGCTGCCTCGCACTTTCAGTACCTCGAGGACTTTGAAAC
AAGTTTAATT

Figure 14C     Amino acid sequence of the open reading frame of pk32OBN51431102

MGKVAVGATVVCAAAVCAASVYIVRRRMQSSGKWARVIEILRVLEEDCATPIAKLRQVADAMTVEMHAGLASEGGS
KLKMLISYVDNLPSGEEHGFFYALDLGGTNFRVMRVLLGGKQGRVVKQEAKEVSIPPHLMTSGSDELFNFIAEALANF
VATEGEDFHLPEGRQRELGFTFSFPVKQTSLSSGTLIKWTKGFSIEDTVGQDVVGELVKAMERVGLDMNVTALVNDT
VGTLAGGRYYNPDVVAAVILGTGTNAAYVERAHAIPKWHGLLPKSGEMVINMEWGNFRSSHLPLTEYDHLLDFDSLN
PGEQILEKIISGMYLGEILRRVLLKMAEEAAFFGDSIPPKLKVPFIIRTPTMSAMHSDTSPDLKVVGSKLKDILEVPTTLKM
RKVVISLCNIIATRGARLSAAGIYGILKKLGRDAPKDGETTQKSVIAMDGGLFEHYTQFSECMESSLKELLGDEASESVE
VIHSNDGSGVGAALLAASHFQYLEDFETSLI

Figure 15A        Nucleic acid sequence of pk320GM59682267

GTGTCGGTCTCGCCACTGTCACTTTCTTTCTCTCACAAATCACAATGTGCTCCGATAACTACAATCTCTCAA
TTCCCCATTAATTAAAATCAAAATCAAAATCTAATCTGGGTTTCTCCCATCAGAGGACAAAGCTTCCGACTT
TGCGGGATTCGTTCGTATTTGTTTCAGTGCTGTGATGGGGAAGGTCGCGGTGGGAGCTGCCGTTGTCTGCG
CCGCCGCCGTATGCGCTGCGGCGGCGCTGGTGGTGCGCCACCGCATGATTAGTTCCCGGAAGTGGAGTCG
CGCCATGGCGATACTGAAGGAGTTTGAGGAGAAGTGTGGCACCCCAATTGTGAAGCTAAGACAAGTGGCTG
ATGCCATGGATGTTGAGATGCACGCGGGTCTCGCATCTGAAGGTGGTAGCAAGCTCAATATGTTGATCAGT
TTTGTCGATAATCTCCCAACTGGGGATGAGGAAGGCCTCTATTATGCACTGGATCTTGGAGGCACAAACTT
CCGTGTCCTTCGTGTACATTTAAGCGGGAAAGACAAAGGTGTTATCGGCCAGGAGTTTGAAGAAGTTTCAA
TTCCTCCAAATTTGATGACTGGCTCTTCAGAAGCATTGTTTGATTTTATAGCAGCAGCTCTTGCAAAGTTTG
TTGGTTCAGAACCTGAAGGTTTTCATCCTCCCCCTGGCAGACAAAGAGAACTGGGTTTTACATTCTCATTCC
CAGTGAGGCAAACATCGATTGCATCTGGGACTCTAATAAAGTGGACTAAAGGTTTCAATATTGAAGATGTG
GTTGGTGAAGATGTGGTGGGAGAACTAACCAAGTCCATGGAAAAAATTGGCCTGGATATGCGCGTTGCTGC
TCTAGTTAATGATACCATTGGAACATTAGCTGGAGGCAGATTCTACAATCAGGATGTCATTGCTGCTGTGAT
TCTTGGTACTGGGACAAATGCAGCATATGTAGAACGTGCACATGCTATTCCAAAATGGCATGGTCTTCTACC
AAAATCAGGAGATATGGTTATAAACATGGAGTGGGGTAATTTCCGATCATCACATCTTCCTCTAACAGAATA
TGATCTAGCTCTAGATGCTCAGAGCTTAAACCCTGGAGAACAGATTTTTGAGAAGATAATTTCTGGTATGTA
TTTGGGTGAAATTGTAAGGAGAGTTTTGTTGAAGATGGCGGAAGAAGTTGACTTCTTTGGAGATACTGTTCC
TCCAAAATTGAGAATTCCTTTCGTACTTAGGACACCTGACATGTCTGCAATGCATCATGATACATCTTCAGA
TCTGAAGGTGGTTGGAAACAAATTGAAGGATATATTAGAGATCAATAACACATCCCTGAAAATGAGGAAGA
TTGTTGTGGAACTCTGTGATATTGTTGCTAATCGGGGAGCCCGCCTTTCTGCTGCTGGTATTTTTGGCATCC
TCAAGAAAATAGGAAGAGACACAGTAAAGGACGGGAAGAAATCAGTAGTAGCACTGGATGGAGGATTGTTT
GAACACTATACTAAATTCAGAAGTTCCTTGGAGAGTACACTAAAGGAGTTGTTGGGAGATGAGGCAGCTGA
GACAATTGGCATTGAGCAGTCTAATGATGGCTCTGGAATTGGAGCAGCCCTCCTGGCAGCTTCTCACTCCC
AGTATTTGGAAGTGCAGGAGTCCTGAAGATGTGGTTTAATGTCAAGGTAAATCAGTGTAACACTAGTTTCAT
TTTTTTGTATACCTACTAGATCAACAGATTGAAGCAGAAAAGTCTTCGTTACTAGTCCTAGAGAGCTTTTAA
CCAGGAAGGTGGACCAAGTCCACAGTGGAGTTATTTGTAGGGCTGTGTTCTTCTTGCTGCAAATGCAACAT
TGCTGCTTCTCGGCTAATTACTGGTGCATTGTTTTGGTTACAGTGTTTGTCTCTCCCACATCAAAGAATAAT
AGGAGAGATGTAAACTTTTGAGTTGTCTCGTTTTCCCAATGTAACATGTTTTCAATGAGAATAAGTCAGGAT
TAATTTATTGACAAAGGTGAATGATTTCAATTCAAGGCTTTTGAAAAAAAAAAAAAAAAAAAAAAAAAAAAA
AAAAAAAAAAGA

Figure 15B      Nucleic acid sequence of the open reading frame of pk320GM59682267

```
ATGGGGAAGGTCGCGGTGGGAGCTGCCGTTGTCTGCGCCGCCGCCGTATGCGCTGCGGCGGCGCTGGTGG
TGCGCCACCGCATGATTAGTTCCCGGAAGTGGAGTCGCGCCATGGCGATACTGAAGGAGTTTGAGGAGAAG
TGTGGCACCCCAATTGTGAAGCTAAGACAAGTGGCTGATGCCATGGATGTTGAGATGCACGCGGGTCTCGC
ATCTGAAGGTGGTAGCAAGCTCAATATGTTGATCAGTTTTGTCGATAATCTCCCAACTGGGGATGAGGAAG
GCCTCTATTATGCACTGGATCTTGGAGGCACAAACTTCCGTGTCCTTCGTGTACATTTAAGCGGGAAAGAC
AAAGGTGTTATCGGCCAGGAGTTTGAAGAAGTTTCAATTCCTCCAAATTTGATGACTGGCTCTTCAGAAGCA
TTGTTTGATTTTATAGCAGCAGCTCTTGCAAAGTTTGTTGGTTCAGAACCTGAAGGTTTTCATCCTCCCCCT
GGCAGACAAAGAGAACTGGGTTTTACATTCTCATTCCCAGTGAGGCAAACATCGATTGCATCTGGGACTCT
AATAAAGTGGACTAAAGGTTTCAATATTGAAGATGTGGTTGGTGAAGATGTGGTGGGAGAACTAACCAAGT
CCATGGAAAAAATTGGCCTGGATATGCGCGTTGCTGCTCTAGTTAATGATACCATTGGAACATTAGCTGGA
GGCAGATTCTACAATCAGGATGTCATTGCTGCTGTGATTCTTGGTACTGGGACAAATGCAGCATATGTAGA
ACGTGCACATGCTATTCCAAAATGGCATGGTCTTCTACCAAAATCAGGAGATATGGTTATAAACATGGAGT
GGGGTAATTTCCGATCATCACATCTTCCTCTAACAGAATATGATCTAGCTCTAGATGCTCAGAGCTTAAACC
CTGGAGAACAGATTTTTGAGAAGATAATTTCTGGTATGTATTTGGGTGAAATTGTAAGGAGAGTTTTGTTGA
AGATGGCGGAAGAAGTTGACTTCTTTGGAGATACTGTTCCTCCAAAATTGAGAATTCCTTTCGTACTTAGGA
CACCTGACATGTCTGCAATGCATCATGATACATCTTCAGATCTGAAGGTGGTTGGAAACAAATTGAAGGAT
ATATTAGAGATCAATAACACATCCCTGAAAATGAGGAAGATTGTTGTGGAACTCTGTGATATTGTTGCTAAT
CGGGGAGCCCGCCTTTCTGCTGCTGGTATTTTTGGCATCCTCAAGAAAATAGGAAGAGACACAGTAAAGGA
CGGGAAGAAATCAGTAGTAGCACTGGATGGAGGATTGTTTGAACACTATACTAAATTCAGAAGTTCCTTGG
AGAGTACACTAAAGGAGTTGTTGGAGATGAGGCAGCTGAGACAATTGGCATTGAGCAGTCTAATGATGGC
TCTGGAATTGGAGCAGCCCTCCTGGCAGCTTCTCACTCCCAGTATTTGGAAGTGCAGGAGTCC
```

Figure 15C      Amino acid sequence of the open reading frame of pk320GM59682267

```
MGKVAVGAAVVCAAAVCAAAALVVRHRMISSRKWSRAMAILKEFEEKCGTPIVKLRQVADAMDVEMHAGLASEGG
SKLNMLISFVDNLPTGDEEGLYYALDLGGTNFRVLRVHLSGKDKGVIGQEFEEVSIPPNLMTGSSEALFDFIAAALAKF
VGSEPEGFHPPPGRQRELGFTFSFPVRQTSIASGTLIKWTKGFNIEDVVGEDVVGELTKSMEKIGLDMRVAALVNDTIG
TLAGGRFYNQDVIAAVILGTGTNAAYVERAHAIPKWHGLLPKSGDMVINMEWGNFRSSHLPLTEYDLALDAQSLNP
GEQIFEKIISGMYLGEIVRRVLLKMAEEVDFFGDTVPPKLRIPFVLRTPDMSAMHHDTSSDLKVVGNKLKDILEINNTSL
KMRKIVVELCDIVANRGARLSAAGIFGILKKIGRDTVKDGKKSVVALDGGLFEHYTKFRSSLESTLKELLGDEAAETIGI
EQSNDGSGIGAALLAASHSQYLEVQES
```

Figure 16A    Nucleic acid sequence of pk316BN44215842

ATCCCCCTCTCTCTCTCTCTCTTAAATATCAGTTTTAACAGAAAACCTCATTCTCATTCTCTCTCCTCTGCTT
GACCTCTGTTCTTCAAGTTGTACGACATGGCGGCGACAGGTCAAATCTCGACGAGAATGACGGTGGATCGC
ACTCTGTCCTCCTCCAGGAACGCTGGACTTTCCCTTTCACCATCACCCCAGAGAACGCTAATCGGCGTCGC
CGGTAGGTCTGGTATCGCTCACCGTCAACTGTCTCTCTCCGTCAGAGCGATTAACACCAATGAAGATAGCC
GGAAAGTCAAGGTTTATGCAGAGAACGGCGCTTTCGATTTGGGAGTGATGGATCCTTCAGTGGAGCCATAT
AAATTTGCGGAGCCAAGAACAAGTCATAATGATTCGAGGAGGAAAACCAAGATTGTGTGTACCATTGGACC
TTCCTCTAGCTCTCGTGAAATGATTTGGAAACTCGCGGAAGCAGGAATGAATGTGGCTCGTTTGAATATGTC
TCATGGAGATCATGCTTCTCATCAGATTACTATTGATCTTGTTAAAGAATACAACTCTCTCTTTGTTGACAA
AGCCATTGCTATCATGTTGGATACAAAGGGTCCTGAGGTTCGAAGTGGGGATGTACCTCAGCCGATCTTCC
TTGAAGAGGGTCAAGAGTTTAATTTTACCATCAAGAGAGGTGTCTCAATGAAAGACACCGTCAGTGTCAAC
TATGATGATTTTGTTAACGATGTCGAAGTTGGAGACATACTTTTGGTCGATGGTGGAATGATGTCACTAGCT
GTTAAGTCCAAGACGAGCGATTTGGTGAAATGTGTAGTTATTGACGGTGGAGAGCTTCAATCTAGACGTCA
CTTGAATGTTCGAGGAAAGAGTGCTACTCTTCCTTCCATAACAGACAAAGATTGGGAAGACATCAAATTTG
GAGTGGACAACCAAGTTGATTTCTATGCTGTCTCTTTTGTTAAGGATGCTAAAGTTGTCCATGAGTTGAAAA
ACTACCTCAAAAGCTGCAGTGCGGATATCTCTGTGATTGTGAAAATTGAAAGCGCAGATTCTATAAAGAAT
CTTCCTTCCATTATATCTGCTTGTGATGGGGCAATGGTTGCTCGTGGAGATCTTGGAGCTGAACTTCCCATT
GAGGAGGTTCCCTTGTTACAGGAGGAGATAATCACAAGGTGTAGGAACATTCATAAACCAGTGATTGTCGC
CACAAACATGCTAGAGAGTATGATTAATCATCCAACACCTACAAGAGCTGAAGTATCTGACATTGCAATTG
CAGTGCGCGAAGGAGCAGATGCAATCATGCTTTCTGGTGAAACCGCACACGGAAAGTTTCCTCTGAAAGCT
GTTAACGTGATGCATACCGTGGCTTTGAGAACTGAGGCTAGTCTACCTGTTAGAACCTCAGCAATCCGGAC
CACTGCTTACAAGGGTCGCATGGGCCAAATGTTTGCTTTCCATGCTTCTATAATGGCGAATACACTGAACAC
ACCGATCATTGTGTTCACAAGAACTGGATCCATGGCAGTGCTTCTGAGTCACTACCGCCCGTCCTCAACAA
TTTTCGCCTTCACAAACCAGAGGAGAATAATGCAAAGGCTGGCTCTTTACCAAGGTGTCATGCCTATATACA
TGGAGTTTTCTGATGATGCAGAAGATACATATGCCCGTTCCTTGAAACTCCTACAGGACGAGAATATGCTTA
AGGAAGGACAACATGTAACTCTTGTCCAAAGTGGTGCGCAACCCATTTGGCGTGAAGAATCAACACATCTC
ATACAAGTCCGTAAGATTAAGATAGGTTGATGTTTTTCACTACTCGAGCTTCTATATCCCTGACTTTATTTTT
CTTACACGATTTGATCCAATATTGTTTTATGTCACTCACAGTGAAACCATATATATTTGTTTTAAGTTCTTGA
ACCACATGACTGTAAAAACAAAACAGTCTTTTCGATGAAAAAAAAAAAAAAA

Figure 16B    Nucleic acid sequence of the open reading frame of pk316BN4421 5842

ATGGCGGCGACAGGTCAAATCTCGACGAGAATGACGGTGGATCGCACTCTGTCCTCCTCCAGGAACGCTGG
ACTTTCCCTTTCACCATCACCCCAGAGAACGCTAATCGGCGTCGCCGGTAGGTCTGGTATCGCTCACCGTC
AACTGTCTCTCTCCGTCAGAGCGATTAACACCAATGAAGATAGCCGGAAAGTCAAGGTTTATGCAGAGAAC
GGCGCTTTCGATTTGGGAGTGATGGATCCTTCAGTGGAGCCATATAAATTTGCGGAGCCAAGAACAAGTCA
TAATGATTCGAGGAGGAAAACCAAGATTGTGTGTACCATTGGACCTTCCTCTAGCTCTCGTGAAATGATTTG
GAAACTCGCGGAAGCAGGAATGAATGTGGCTCGTTTGAATATGTCTCATGGAGATCATGCTTCTCATCAGA
TTACTATTGATCTTGTTAAAGAATACAACTCTCTCTTTGTTGACAAAGCCATTGCTATCATGTTGGATACAA
AGGGTCCTGAGGTTCGAAGTGGGGATGTACCTCAGCCGATCTTCCTTGAAGAGGGTCAAGAGTTTAATTTT
ACCATCAAGAGAGGTGTCTCAATGAAAGACACCGTCAGTGTCAACTATGATGATTTTGTTAACGATGTCGA
AGTTGGAGACATACTTTTGGTCGATGGTGGAATGATGTCACTAGCTGTTAAGTCCAAGACGAGCGATTTGG
TGAAATGTGTAGTTATTGACGGTGGAGAGCTTCAATCTAGACGTCACTTGAATGTTCGAGGAAAGAGTGCT
ACTCTTCCTTCCATAACAGACAAAGATTGGGAAGACATCAAATTTGGAGTGGACAACCAAGTTGATTTCTAT
GCTGTCTCTTTTGTTAAGGATGCTAAAGTTGTCCATGAGTTGAAAAACTACCTCAAAAGCTGCAGTGCGGAT
ATCTCTGTGATTGTGAAAATTGAAAGCGCAGATTCTATAAAGAATCTTCCTTCCATTATATCTGCTTGTGAT
GGGGCAATGGTTGCTCGTGGAGATCTTGGAGCTGAACTTCCCATTGAGGAGGTTCCCTTGTTACAGGAGGA
GATAATCACAAGGTGTAGGAACATTCATAAACCAGTGATTGTCGCCACAAACATGCTAGAGAGTATGATTA
ATCATCCAACACCTACAAGAGCTGAAGTATCTGACATTGCAATTGCAGTGCGCGAAGGAGCAGATGCAATC
ATGCTTTCTGGTGAAACCGCACACGGAAAGTTTCCTCTGAAAGCTGTTAACGTGATGCATACCGTGGCTTTG
AGAACTGAGGCTAGTCTACCTGTTAGAACCTCAGCAATCCGGACCACTGCTTACAAGGGTCGCATGGGCCA
AATGTTTGCTTTCCATGCTTCTATAATGGCGAATACACTGAACACACCGATCATTGTGTTCACAAGAACTGG
ATCCATGGCAGTGCTTCTGAGTCACTACCGCCCGTCCTCAACAATTTTCGCCTTCACAAACCAGAGGAGAA
TAATGCAAAGGCTGGCTCTTTACCAAGGTGTCATGCCTATATACATGGAGTTTTCTGATGATGCAGAAGATA
CATATGCCCGTTCCTTGAAACTCCTACAGGACGAGAATATGCTTAAGGAAGGACAACATGTAACTCTTGTC
CAAAGTGGTGCGCAACCCATTTGGCGTGAAGAATCAACACATCTCATACAAGTCCGTAAGATTAAGATAGG
T

Figure 16C    Amino acid sequence of the open reading frame of pk316BN4421 5842

MAATGQISTRMTVDRTLSSSRNAGLSLSPSPQRTLIGVAGRSGIAHRQLSLSVRAINTNEDSRKVKVYAENGAFDLGV
MDPSVEPYKFAEPRTSHNDSRRKTKIVCTIGPSSSREMIWKLAEAGMNVARLNMSHGDHASHQITIDLVKEYNSLFV
DKAIAIMLDTKGPEVRSGDVPQPIFLEEGQEFNFTIKRGVSMKDTVSVNYDDFVNDVEVGDILLVDGGMMSLAVKSK
TSDLVKCVVIDGGELQSRRHLNVRGKSATLPSITDKDWEDIKFGVDNQVDFYAVSFVKDAKVVHELKNYLKSCSADI
SVIVKIESADSIKNLPSIISACDGAMVARGDLGAELPIEEVPLLQEEIITRCRNIHKPVIVATNMLESMINHPTPTRAEVSDI
AIAVREGADAIMLSGETAHGKFPLKAVNVMHTVALRTEASLPVRTSAIRTTAYKGRMGQMFAFHASIMANTLNTPIIV
FTRTGSMAVLLSHYRPSSTIFAFTNQRRIMQRLALYQGVMPIYMEFSDDAEDTYARSLKLLQDENMLKEGQHVTLVQ
SGAQPIWREESTHLIQVRKIKIG

NUCLEIC ACID MOLECULES ENCODING POLYPEPTIDES INVOLVED IN REGULATION OF SUGAR AND LIPID METABOLISM AND METHODS OF USE VIII

RELATED APPLICATIONS

This application is a national stage application (under 35 U.S.C. §371) of PCT/EP2006/069271, filed Dec. 4, 2006, which claims benefit of U.S. provisional application 60/597,558, filed Dec. 9, 2005.

SEQUENCE LISTING SUBMISSION

The Sequence Listing associated with this application is filed in electronic format via EFS-Web and hereby incorporated by reference into the specification in its entirety. The name of the text file containing the Sequence Listing is Revised Sequence List 13156 00170 US. The size of the text file is 3,378 KB, and the text file was created on Aug. 27, 2008.

Described herein are inventions in the field of genetic engineering of plants, including isolated nucleic acid molecules to improve agronomic, horticultural, and quality traits. This invention relates generally to nucleic acid sequences encoding proteins that are related to the presence of seed storage compounds in plants. More specifically, the present invention relates to Arabidopsis thaliana, Brassica napus, Glycine max and Oryza sativa nucleic acid sequences encoding sugar and lipid metabolism regulator proteins and the use of these sequences in transgenic plants. In particular, the invention is directed to methods for manipulating sugar-related compounds and for increasing oil level and altering the fatty acid composition in plants and seeds. The invention further relates to methods of using these novel plant polypeptides to stimulate plant growth and/or to increase yield and/or composition of seed storage compounds.

The study and genetic manipulation of plants has a long history that began even before the framed studies of Gregor Mendel. In perfecting this science, scientists have accomplished modification of particular traits in plants ranging from potato tubers having increased starch content to oilseed plants such as canola and sunflower having increased or altered fatty acid content. With the increased consumption and use of plant oils, the modification of seed oil content and seed oil levels has become increasingly widespread (e.g. Töpfer et al. 1995, Science 268:681-686). Manipulation of biosynthetic pathways in transgenic plants provides a number of opportunities for molecular biologists and plant biochemists to affect plant metabolism giving rise to the production of specific higher-value products. The seed oil production or composition has been altered in numerous traditional oilseed plants such as soybean (U.S. Pat. No. 5,955,650), canola (U.S. Pat. No. 5,955,650), sunflower (U.S. Pat. No. 6,084,164), and rapeseed (Töpfer et al. 1995, Science 268:681-686), and non-traditional oil seed plants such as tobacco (Cahoon et al. 1992, Proc. Natl. Acad. Sci. USA 89:11184-11188).

Plant seed oils comprise both neutral and polar lipids (see Table 13). The neutral lipids contain primarily triacylglycerol, which is the main storage lipid that accumulates in oil bodies in seeds. The polar lipids are mainly found in the various membranes of the seed cells, e.g. the endoplasmic reticulum, microsomal membranes, and the cell membrane. The neutral and polar lipids contain several common fatty acids (see Table 14) and a range of less common fatty acids. The fatty acid composition of membrane lipids is highly regulated and only a select number of fatty acids are found in membrane lipids. On the other hand, a large number of unusual fatty acids can be incorporated into the neutral storage lipids in seeds of many plant species (Van de Loo F. J. et al. 1993, "Unusual Fatty Acids in Lipid Metabolism in Plants," pp. 91-126, editor T S Moore Jr., CRC Press; Millar et al., 2000, Trends Plant Sci., 5:95-101).

Lipids are synthesized from fatty acids, and their synthesis may be divided into two parts: The prokaryotic pathway and the eukaryotic pathway (Browse et al. 1986, Biochemical J. 235:25-31; Ohlrogge & Browse 1995, Plant Cell 7:957-970). The prokaryotic pathway is located in plastids that are the primary site of fatty acid biosynthesis. Fatty acid synthesis begins with the conversion of acetyl-CoA to malonyl-CoA by acetyl-CoA carboxylase (ACCase). Malonyl-CoA is converted to malonyl-acyl carrier protein (ACP) by the malonyl-CoA:ACP transacylase. The enzyme beta-keto-acyl-ACP-synthase III (KAS III) catalyzes a condensation reaction, in which the acyl group from acetyl-CoA is transferred to malonyl-ACP to form 3-ketobutyryl-ACP. In a subsequent series of condensation, reduction, and dehydration reactions, the nascent fatty acid chain on the ACP cofactor is elongated by the step-by-step addition (condensation) of two carbon atoms donated by malonyl-ACP until a 16- or 18-carbon saturated fatty acid chain is formed. The plastidial delta-9 acyl-ACP desaturase introduces the first unsaturated double bond into the fatty acid. Thioesterases cleave the fatty acids from the ACP cofactor and free fatty acids are exported to the cytoplasm, where they participate as fatty acyl-CoA esters in the eukaryotic pathway. In this pathway the fatty acids are esterified by glycerol-3-phosphate acyltransferase and lysophosphatidic acid acyl-transferase to the sn-1 and sn-2 positions of glycerol-3-phosphate, respectively, to yield phosphatidic acid (PA). The PA is the precursor for other polar and neutral lipids, the latter being formed in the Kennedy pathway (Voelker 1996, Genetic Engineering ed.: Setlow 18:111-113; Shanklin & Cahoon 1998, Annu. Rev. Plant Physiol. Plant Mol. Biol. 49:611-641; Frentzen 1998, Lipids 100:161-166; Millar et al. 2000, Trends Plant Sci. 5:95-101).

Storage lipids in seeds are synthesized from carbohydrate-derived precursors. Plants have a complete glycolytic pathway in the cytosol (Plaxton 1996, Annu. Rev. Plant Physiol. Plant Mol. Biol. 47:185-214), and it has been shown that a complete pathway also exists in the plastids of rapeseeds (Kang & Rawsthorne 1994, Plant J. 6:795-805). Sucrose is the primary source of carbon and energy, transported from the leaves into the developing seeds. During the storage phase of seeds, sucrose is converted in the cytosol to provide the metabolic precursors glucose-6-phosphate and pyruvate. These are transported into the plastids and converted into acetyl-CoA that serves as the primary precursor for the synthesis of fatty acids. Acetyl-CoA in the plastids is the central precursor for lipid biosynthesis. Acetyl-CoA can be formed in the plastids by different reactions and the exact contribution of each reaction is still being debated (Ohlrogge & Browse 1995, Plant Cell 7:957-970). It is however accepted that a large part of the acetyl-CoA is derived from glucose-6-phosphate and pyruvate that are imported from the cytoplasm into the plastids. Sucrose is produced in the source organs (leaves, or anywhere that photosynthesis occurs) and is transported to the developing seeds that are also termed sink organs. In the developing seeds, sucrose is the precursor for all the storage compounds, i.e. starch, lipids, and partly the seed-storage proteins. Therefore, it is clear that carbohydrate metabolism, in which sucrose plays a central role, is very important to the accumulation of seed storage compounds.

Storage compounds, such as triacylglycerols (seed oil), serve as carbon and energy reserves, which are used during germination and growth of the young seedling. Seed (vegetable) oil is also an essential component of the human diet and a valuable commodity providing feed stocks for the chemical industry.

Although the lipid and fatty acid content, and/or composition of seed oil, can be modified by the traditional methods of plant breeding, the advent of recombinant DNA technology has allowed for easier manipulation of the seed oil content of a plant, and, in some cases, has allowed for the alteration of seed oils in ways that could not be accomplished by breeding alone (see, e.g., Töpfer et al. 1995, Science 268:681-686). For example, introduction of a $\Delta^{12}$-hydroxylase nucleic acid sequence into transgenic tobacco resulted in the introduction of a novel fatty acid, ricinoleic acid, into the tobacco seed oil (Van de Loo et al. 1995, Proc. Natl. Acad. Sci. USA 92:6743-6747). Tobacco plants have also been engineered to produce low levels of petroselinic acid by the introduction and expression of an acyl-ACP desaturase from coriander (Cahoon et al. 1992, Proc. Natl. Acad. Sci. USA 89:11184-11188).

The modification of seed oil content in plants has significant medical, nutritional, and economic ramifications. With regard to the medical ramifications, the long chain fatty acids (C18 and longer) found in many seed oils have been linked to reductions in hypercholesterolemia and other clinical disorders related to coronary heart disease (Brenner 1976, Adv. Exp. Med. Biol. 83:85-101). Therefore, consumption of a plant having increased levels of these types of fatty acids may reduce the risk of heart disease. Enhanced levels of seed oil content also increase large-scale production of seed oils and thereby reduce the cost of these oils.

In order to increase or alter the levels of compounds such as seed oils in plants, nucleic acid sequences and proteins regulating lipid and fatty-acid metabolism must be identified. As mentioned earlier, several desaturase nucleic acids such as the $\Delta^6$-desaturase nucleic acid, $\Delta^{12}$-desaturase nucleic acid, and acyl-ACP desaturase nucleic acid have been cloned and demonstrated to encode enzymes required for fatty acid synthesis in various plant species. Oleosin nucleic acid sequences from such different species as canola, soybean, carrot, pine, and *Arabidopsis thaliana* have also been cloned and determined to encode proteins associated with the phospholipid monolayer membrane of oil bodies in those plants.

It has also been determined that two phytohormones, gibberellic acid (GA), and abisisic acid (ABA), are involved in overall regulatory processes in seed development (e.g. Ritchie & Gilroy 1998, Plant Physiol. 116:765-776; Arenas-Huertero et al. 2000, Genes Dev. 14:2085-2096). Both the GA and ABA pathways are affected by okadaic acid, a protein phosphatase inhibitor (Kuo et al. 1996, Plant Cell. 8:259-269). The regulation of protein phosphorylation by kinases and phosphatases is accepted as a universal mechanism of cellular control (Cohen 1992, Trends Biochem. Sci. 17:408-413). Likewise, the plant hormones ethylene (e.g. Zhou et al. 1998, Proc. Natl. Acad. Sci. USA 95:10294-10299; Beaudoin et al. 2000, Plant Cell 2000:1103-1115), and auxin (e.g. Colon-Carmona et al. 2000, Plant Physiol. 124:1728-1738) are involved in controlling plant development as well.

Thus, the technical problem underlying the present invention may be seen as the provision of means and methods for complying with the aforementioned needs. The technical problem is solved by the embodiments characterized in the claims and herein below. In principle, this invention discloses nucleic acid sequences from *Arabidopsis thaliana, Brassica napus, Glycine max* and *Oryza sativa*. These nucleic acid sequences can be used to alter or increase the levels of seed storage compounds such as proteins, sugars, and oils in plants, including transgenic plants, such as canola, linseed, soybean, sunflower, maize, oat, rye, barley, wheat, rice, pepper, tagetes, cotton, oil palm, coconut palm, flax, castor, and peanut, which are oilseed plants containing high amounts of lipid compounds.

Accordingly, the present invention relates to a polynucleotide which comprises a nucleic acid sequence selected from the group consisting of:

(a) a nucleic acid sequence as shown in SEQ ID NO: 1, 3, 5, 7, 9, 11, 13, 15, 17, 19, 21, 23, 25, 27, 29, 31, 33, 35, 37, 39, 41, 43, 45, 47, 63, 65, 67, 69, 71, 73, 75, 77, 87, 89, 91, 93, 95, 97, 99, 101, 103, 105, 107, 109, 111, 113, 115, 117, 119, 121, 123, 125, 127, 129, 131, 133, 135, 137, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 238, 240, 242, 244, 246, 248, 250, 252, 254, 256, 258, 260, 262, 264, 266, 273, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 552, 554, 556, 558, 560, 562, 564, 566, 568, 570, 572, 574, 576, 578, 580, 582, 591, 593, 595, 597, 599, 601, 603, 605, 607, 609, 611, 613, 615, 625, 627, 629, 631, 633, 635, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 778, 780, 782, 784, 786, 788, 790, 792, 794, 796, 798, 800, 802, 804, or 806;

(b) a nucleic acid sequence encoding a polypeptide having an amino acid sequence as shown in SEQ ID NO: 2, 4, 6, 8, 10, 12, 14, 16, 18, 20, 22, 24, 26, 28, 30, 32, 34, 36, 38, 40, 42, 44, 46, 48, 64, 66, 68, 70, 72, 74, 76, 78, 88, 90, 92, 94, 96, 98, 100, 102, 104, 106, 108, 110, 112, 114, 116, 118, 120, 122, 124, 126, 128, 130, 132, 134, 136, 138, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 241, 243, 245, 247, 249, 251, 253, 255, 257, 259, 261, 263, 265, 267, 274, 276, 278, 280, 282, 284, 286, 288, 290, 292, 294, 296, 298, 300, 302, 304, 306, 308, 310, 312, 314, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 553, 555, 557, 559, 561, 563, 565, 567, 569, 571, 573, 575, 577, 579, 581, 583, 592, 594, 596, 598, 600, 602, 604, 606, 608, 610, 612, 614, 616, 626, 628, 630, 632, 634, 636, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 779, 781, 783, 785, 787, 789, 791, 793, 795, 797, 799, 801, 803, 805 or 807;

(c) a nucleic acid sequence which is at least 70% identical to the nucleic acid sequence of (a) or (b), wherein said nucleic acid sequence encodes a polypeptide or biologically active portion thereof being capable of increasing the seed storage compound content when expressed in transgenic plants; and (d) a nucleic acid sequence being a fragment of any one of (a) to (c), wherein said fragment encodes a polypeptide or biologically active portion thereof being capable of increasing the seed storage compound content when expressed in transgenic plants.

The term "polynucleotide" as used in accordance with the present invention relates to a polynucleotide comprising a nucleic acid sequence which encodes a polypeptide being capable of increasing the seed storage compound content and, preferably, the total fatty acid content when expressed in transgenic plants. More preferably, the polypeptide encoded by the polynucleotide of the present invention has a biological activity as indicated in Table 15. The polypeptides encoded by the polynucleotide of the present invention are also referred to as lipid metabolism proteins (LMP) herein below. Suitable assays for measuring the activities mentioned before are well known in the art and are described in the accompanying Examples. Preferably, the polynucleotide of the present invention upon expression in a plant seed, preferably in a plant seed of the *Arabidopsis thaliana* ecotype Columbia-2, shall be capable of significantly increasing the total fatty acid content. How to determine whether an increase is significant is described elsewhere in this specification. Further details are to be found in the accompanying Examples, below.

Preferably, the polynucleotide of the present invention upon expression in the seed of a transgenic plant is capable of significantly increasing the amount by weight of at least one seed storage compound, more preferably, of the fatty acids. More preferably, such an increase as referred to in accordance with the present invention is an increase of the amount by weight of at least 1, 2.5, 5, 7.5, 10, 12.5, 15, 17.5, 20, 22.5 or 25% as compared to a control. Whether an increase is significant can be determined by statistical tests well known in the art including, e.g., Student's t-test. The percent increase rates of a seed storage compound are, preferably, determined compared to an empty vector control. An empty vector control is a transgenic plant, which has been transformed with the same vector or construct as a transgenic plant according to the present invention except for such a vector or construct is lacking the polynucleotide of the present invention. Alternatively, an untreated plant (i.e. a plant which has not been genetically manipulated) may be used as a control.

A polynucleotide encoding a polypeptide having a biological activity as specified above has been obtained in accordance with the present invention from *Arabidopsis thaliana*, *Brassica napus* or *Glycine max*. The corresponding polynucleotides, preferably, comprises the nucleic acid sequence shown in SEQ ID NO: 1, 3, 5, 7, 9, 11, 13, 15, 17, 19, 21, 23, 25, 27, 29, 31, 33, 35, 37, 39, 41, 43, 45, 47, 63, 65, 67, 69, 71, 73, 75, 77, 87, 89, 91, 93, 95, 97, 99, 101, 103, 105, 107, 109, 111, 113, 115, 117, 119, 121, 123, 125, 127, 129, 131, 133, 135, 137, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 238, 240, 242, 244, 246, 248, 250, 252, 254, 256, 258, 260, 262, 264, 266, 273, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 552, 554, 556, 558, 560, 562, 564, 566, 568, 570, 572, 574, 576, 578, 580, 582, 591, 593, 595, 597, 599, 601, 603, 605, 607, 609, 611, 613, 615, 625, 627, 629, 631, 633, 635, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 778, 780, 782, 784, 786, 788, 790, 792, 794, 796, 798, 800, 802, 804, or 806 encoding a polypeptide having the amino acid sequence of SEQ ID NO: 2, 4, 6, 8, 10, 12, 14, 16, 18, 20, 22, 24, 26, 28, 30, 32, 34, 36, 38, 40, 42, 44, 46, 48, 64, 66, 68, 70, 72, 74, 76, 78, 88, 90, 92, 94, 96, 98, 100, 102, 104, 106, 108, 110, 112, 114, 116, 118, 120, 122, 124, 126, 128, 130, 132, 134, 136, 138, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 241, 243, 245, 247, 249, 251, 253, 255, 257, 259, 261, 263, 265, 267, 274, 276, 278, 280, 282, 284, 286, 288, 290, 292, 294, 296, 298, 300, 302, 304, 306, 308, 310, 312, 314, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 553, 555, 557, 559, 561, 563, 565, 567, 569, 571, 573, 575, 577, 579, 581, 583, 592, 594, 596, 598, 600, 602, 604, 606, 608, 610, 612, 614, 616, 626, 628, 630, 632, 634, 636, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 779, 781, 783, 785, 787, 789, 791, 793, 795, 797, 799, 801, 803, 805 or 807.

It is to be understood that a polypeptide having the aforementioned specific amino acid sequences may be encoded due to the degenerated genetic code by other polynucleotides as well.

Moreover, the term "polynucleotide" as used in accordance with the present invention further encompasses variants of the aforementioned specific polynucleotides. Said variants may represent orthologs, paralogs or other homologs of the polynucleotide of the present invention.

The polynucleotide variants, preferably, also comprise a nucleic acid sequence characterized in that the sequence can be derived from the aforementioned specific nucleic acid sequences shown in SEQ ID NO: 1, 3, 5, 7, 9, 11, 13, 15, 17, 19, 21, 23, 25, 27, 29, 31, 33, 35, 37, 39, 41, 43, 45, 47, 63, 65, 67, 69, 71, 73, 75, 77, 87, 89, 91, 93, 95, 97, 99, 101, 103, 105, 107, 109, 111, 113, 115, 117, 119, 121, 123, 125, 127, 129, 131, 133, 135, 137, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 238, 240, 242, 244, 246, 248, 250, 252, 254, 256, 258, 260, 262, 264, 266, 273, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 552, 554, 556, 558, 560, 562, 564, 566, 568, 570, 572, 574, 576, 578, 580, 582, 591, 593, 595, 597, 599, 601, 603, 605, 607, 609, 611, 613, 615, 625, 627, 629, 631, 633, 635, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 778, 780, 782, 784, 786, 788, 790, 792, 794, 796, 798, 800, 802, 804, or 806 by at least one nucleotide substitution, addition and/or deletion whereby the variant nucleic acid sequence shall still encode a polypeptide having a biological activity as specified above. Variants also encompass polynucleotides comprising a nucleic acid sequence which is capable of hybridizing to the aforementioned specific nucleic acid sequences, preferably, under stringent hybridization conditions. These stringent conditions are known to the skilled worker and can be found in Current Protocols in Molecular Biology, John Wiley & Sons, N.Y. (1989), 6.3.1-6.3.6. A preferred example for stringent hybridization conditions are hybridization conditions in 6× sodium chloride/sodium citrate (=SSC) at approximately 45° C., followed by one or more wash steps in 0.2×SSC, 0.1% SDS at 50 to 65° C. The skilled worker knows that these hybridization conditions differ depending on the type of nucleic acid and, for example when organic solvents are present, with regard to the temperature and concentration of the buffer. For example, under "standard hybridization conditions" the temperature differs depending on the type of nucleic acid between 42° C. and 58° C. in aqueous buffer with a concentration of 0.1 to 5×SSC (pH 7.2). If organic solvent is present in the abovementioned buffer, for example 50% formamide, the temperature under standard conditions is approximately 42° C. The hybridization conditions for DNA: DNA hybrids are, preferably, 0.1×SSC and 20° C. to 45° C., preferably between 30° C. and 45° C. The hybridization conditions for DNA:RNA hybrids are, preferably, 0.1×SSC and 30° C. to 55° C., preferably between 45° C. and 55° C. The abovementioned hybridization temperatures are determined for example for a nucleic acid with approximately 100 bp (=base pairs) in length and a G+C content of 50% in the absence of formamide. The skilled worker knows how to determine the hybridization conditions required by referring to textbooks such as the textbook mentioned above, or the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford. Alternatively, polynucleotide variants are obtainable by PCR-based techniques such as mixed oligonucleotide primer-based amplification of DNA, i.e. using degenerated primers against conserved domains of the polypeptides of the present invention. Conserved domains of the polypeptide of the present invention may be identified by a sequence comparison of the nucleic acid sequences of the polynucleotides or the amino acid sequences of the polypeptides of the present invention. Oligonucleotides suitable as PCR primers as well as suitable PCR conditions are described in the accompanying Examples. As a template, DNA or cDNA from bacteria, fungi, plants or animals may be used. Further, variants include polynucleotides comprising nucleic acid sequences which are at least 70%, at least 75%, at least 80%, at least 85%, at least 90%, at least 95%, at least 98% or at least 99% identical to the nucleic acid sequences shown in SEQ ID NO: 1, 3, 5, 7, 9, 11, 13, 15, 17, 19, 21, 23, 25, 27, 29, 31, 33, 35, 37, 39, 41, 43, 45, 47, 63, 65, 67, 69, 71, 73, 75, 77, 87, 89, 91, 93, 95, 97, 99, 101, 103, 105, 107, 109, 111, 113, 115, 117, 119, 121, 123, 125, 127, 129, 131, 133, 135, 137, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 238, 240, 242, 244, 246, 248, 250, 252, 254, 256, 258, 260, 262, 264, 266, 273, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 552, 554, 556, 558, 560, 562, 564, 566, 568, 570, 572, 574, 576, 578, 580, 582, 591, 593, 595, 597, 599, 601, 603, 605, 607, 609, 611, 613, 615, 625, 627, 629, 631, 633, 635, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 778, 780, 782, 784, 786, 788, 790, 792, 794, 796, 798, 800, 802, 804, or 806 retaining a biological activity as specified above. Moreover, also encompassed are polynucleotides which comprise nucleic acid sequences encoding amino acid sequences which are at least 70%, at least 75%, at least 80%, at least 85%, at least 90%, at least 95%, at least 98% or at least 99% identical to the amino acid sequences shown in SEQ ID NO: 2, 4, 6, 8, 10, 12, 14, 16, 18, 20, 22, 24, 26, 28, 30, 32, 34, 36, 38, 40, 42, 44, 46, 48, 64, 66, 68, 70, 72, 74, 76, 78, 88, 90, 92, 94, 96, 98, 100, 102, 104, 106, 108, 110, 112, 114, 116, 118, 120, 122, 124, 126, 128, 130, 132, 134, 136, 138, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 241, 243, 245, 247, 249, 251, 253, 255, 257, 259, 261, 263, 265, 267, 274, 276, 278, 280, 282, 284, 286, 288, 290, 292, 294, 296, 298, 300, 302, 304, 306, 308, 310, 312, 314, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 553, 555, 557, 559, 561, 563, 565, 567, 569, 571, 573, 575, 577, 579, 581, 583, 592, 594, 596, 598, 600, 602, 604, 606, 608, 610, 612, 614, 616, 626, 628, 630, 632, 634, 636, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 779, 781, 783, 785, 787, 789, 791, 793, 795, 797, 799, 801, 803, 805 or 807 wherein the polypeptide comprising the amino acid sequence retains a biological activity as specified above. The percent identity values are, preferably, calculated over the entire amino acid or nucleic acid sequence region. A series of programs based on a variety of algorithms is available to the skilled worker for comparing different sequences. In this context, the algorithms of Needleman and Wunsch or Smith and Waterman give particularly reliable results. To carry out the sequence alignments, the program PileUp (J. Mol. Evolution., 25, 351-360, 1987, Higgins et al., CABIOS, 5 1989: 151-153) or the programs Gap and BestFit (Needleman and Wunsch (J. Mol. Biol. 48; 443-453 (1970)) and Smith and Waterman (Adv. Appl. Math. 2; 482-489 (1981))), which are part of the GCG software packet [Genetics Computer Group, 575 Science Drive, Madison, Wis., USA 53711 (1991)], are to be used. The sequence identity values recited above in percent (%) are to be determined, preferably, using the program GAP over the entire sequence region with the following settings: Gap Weight: 50, Length Weight: 3, Average Match: 10.000 and Average Mismatch: 0.000, which, unless otherwise specified, shall always be used as standard settings for sequence alignments. For the purposes of the invention, the percent sequence identity between two nucleic acid or polypeptide sequences can be also determined using the Vector NTI 7.0 (PC) software package (InforMax, 7600 Wisconsin Ave., Bethesda, Md. 20814). A gap-opening penalty of 15 and a gap extension penalty of 6.66 are used for determining the percent identity of two nucleic acids. A gap-opening penalty of 10 and a gap extension penalty of 0.1 are used for determining the percent identity of two polypeptides. All other parameters are set at the default settings. For purposes of a multiple alignment (Clustal W algorithm), the gap-opening penalty is 10, and the gap extension penalty is 0.05 with blosum62 matrix. It is to be understood that for the purposes of determining sequence identity when comparing a DNA sequence to an RNA sequence, a thymidine nucleotide sequence is equivalent to a uracil nucleotide.

A polynucleotide comprising a fragment of any of the aforementioned nucleic acid sequences is also encompassed as a polynucleotide of the present invention. The fragment shall encode a polypeptide which still has a biological activity as specified above. Accordingly, the polypeptide may comprise or consist of the domains of the polypeptide of the present invention conferring the said biological activity. A fragment as meant herein, preferably, comprises at least 20, at least 50, at least 100, at least 250 or at least 500 consecutive nucleotides of any one of the aforementioned nucleic acid sequences or encodes an amino acid sequence comprising at least 20, at least 30, at least 50, at least 80, at least 100 or at least 150 consecutive amino acids of any one of the aforementioned amino acid sequences.

More preferably, said variant polynucleotides encoding a variant polypeptide of the polypeptide shown in SEQ ID NO: 2 comprise at least one of the amino acid sequence patterns shown in any one of SEQ ID NOs: 49, 50, 51, 52, 53, 54, 55, 56, 57, 58, 59, 60, 61 or 62. More preferably, said variant polynucleotides encoding a variant polypeptide of the polypeptide shown in SEQ ID NO: 64 comprise at least one of the amino acid sequence patterns shown in any one of SEQ ID NOs: 79, 80, 81, 82, 83, 84, 85 or 86. More preferably, said variant polynucleotides encoding a variant polypeptide of the polypeptide shown in SEQ ID NO: 88 comprise at least one of the amino acid sequence patterns shown in any one of SEQ ID NOs: 149, 150, 151, 152, 153, 154, 155, 156 or 157. More preferably, said variant polynucleotides encoding a variant polypeptide of the polypeptide shown in SEQ ID NO: 159 comprise at least one of the amino acid sequence patterns shown in any one of SEQ ID NOs: 230, 231, 232, 233, 234, 235, 236 or 237. More preferably, said variant polynucleotides encoding a variant polypeptide of the polypeptide shown in SEQ ID NO: 239 comprise at least one of the amino acid sequence patterns shown in any one of SEQ ID NOs: 268 269, 270, 271 or 272. More preferably, said variant polynucleotides encoding a variant polypeptide of the polypeptide shown in SEQ ID NO: 274 comprise at least one of the amino acid sequence patterns shown in any one of SEQ ID NOs: 315, 316, 317, 318, 319 or 320. More preferably, said variant polynucleotides encoding a variant polypeptide of the polypeptide shown in SEQ ID NO: 322 comprise at least one of the amino acid sequence patterns shown in any one of SEQ ID NOs: 541, 542, 543, 544, 545, 546, 547, 548, 549, 550 or 551. More preferably, said variant polynucleotides encoding a variant polypeptide of the polypeptide shown in SEQ ID NO: 553 comprise at least one of the amino acid sequence patterns shown in any one of SEQ ID NOs: 586, 587, 588, 589, 590, 549, 550 or 551. More preferably, said variant polynucleotides encoding a variant polypeptide of the polypeptide shown in SEQ ID NO: 592 comprise at least one of the amino acid sequence patterns shown in any one of SEQ ID NOs: 621, 622, 623, 624, 549, 550 or 551. More preferably, said variant polynucleotides encoding a variant polypeptide of the polypeptide shown in SEQ ID NO: 626 comprise at least one of the amino acid sequence patterns shown in any one of SEQ ID NOs: 643, 644, 645, 646, 647, 648, 649, 650, 651, 652, 653, 654, 655 or 656. More preferably, said variant polynucleotides encoding a variant polypeptide of the polypeptide shown in SEQ ID NO: 658 comprise at least one of the amino acid sequence patterns shown in any one of SEQ ID NOs: 771, 772, 773, 774, 775, 776 or 777. More preferably, said variant polynucleotides encoding a variant polypeptide of the polypeptide shown in SEQ ID NO: 779 comprise at least one of the amino acid sequence patterns shown in any one of SEQ ID NOs: 816, 817, 818, 819, 820, 821, 822, 823 or 824.

Furthermore preferably, a variant polynucleotide of a polynucleotide encoding an amino acid sequence as shown in SEQ ID NO: 2 encodes an amino acid sequence as shown in any one of SEQ ID NOs.: 4, 6, 8, 10, 12, 14, 16, 18, 20, 22, 24, 26, 28, 30, 32, 34, 36, 38, 40, 42, 44, 46 or 48, a variant polynucleotide of a polynucleotide encoding an amino acid sequence as shown in SEQ ID NO: 64 encodes an amino acid sequence as shown in any one of SEQ ID NOs.: 66, 68, 70, 72, 74, 76 or 78, a variant polynucleotide of a polynucleotide encoding an amino acid sequence as shown in SEQ ID NO: 88 encodes an amino acid sequence as shown in any one of SEQ ID NOs.: 90, 92, 94, 96, 98, 100, 102, 104, 106, 108, 110, 112, 114, 116, 118, 120, 122, 124, 126, 128, 130, 132, 134, 136 or 138, a variant polynucleotide of a polynucleotide encoding an amino acid sequence as shown in SEQ ID NO: 159 encodes an amino acid sequence as shown in any one of SEQ ID NOs.: 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227 or 229, a variant polynucleotide of a polynucleotide encoding an amino acid sequence as shown in SEQ ID NO: 239 encodes an amino acid sequence as shown in any one of SEQ ID NOs.: 241, 243, 245, 247, 249, 251, 253, 255, 257, 259, 261, 263, 265 or 267, a variant polynucleotide of a polynucleotide encoding an amino acid sequence as shown in SEQ ID NO: 274 encodes an amino acid sequence as shown in any one of SEQ ID NOs.: 276, 278, 280, 282, 284, 286, 288, 290, 292, 294, 296, 298, 300, 302, 304, 306, 308, 310, 312 or 314, a variant polynucleotide of a polynucleotide encoding an amino acid sequence as shown in SEQ ID NO: 322 encodes an amino acid sequence as shown in any one of SEQ ID NOs.: 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520 or 522, a variant polynucleotide of a polynucleotide encoding an amino acid sequence as shown in SEQ ID NO: 553 encodes an amino acid sequence as shown in any one of SEQ ID NOs.: 555, 557, 559, 561, 563, 565, 567, 569, 571, 573, 575, 577, 579, 581 or 583, a variant polynucleotide of a polynucleotide encoding an amino acid sequence as shown in SEQ ID NO: 592 encodes an amino acid sequence as shown in any one of SEQ ID NOs.: 594, 596, 598, 600, 602, 604, 606, 608, 610, 612, 614 or 616, a variant polynucleotide of a polynucleotide encoding an amino acid sequence as shown in SEQ ID NO: 626 encodes an amino acid sequence as shown in any one of SEQ ID NOs.: 628, 630, 632, 634 or 636, a variant polynucleotide of a polynucleotide encoding an amino acid sequence as shown in SEQ ID NO: 658 encodes an amino acid sequence as shown in any one of SEQ ID NOs.: 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764 or 766, and a variant polynucleotide of a polynucleotide encoding an amino acid sequence as shown in SEQ ID NO: 779 encodes an amino acid sequence as shown in any one of SEQ ID NOs.: 781, 783, 785, 787, 789, 791, 793, 795, 797, 799, 801, 803, 805 or 807.

Most preferably, variant polynucleotides of the polynucleotide shown in SEQ ID NO: 1 are shown in any one of SEQ ID NOs: 3, 5, 7, 9, 11, 13, 15, 17, 19, 21, 23, 25, 27, 29, 31, 33, 35, 37, 39, 41, 43, 45 or 47, variant polynucleotides of the polynucleotide shown in SEQ ID NO: 63 are shown in any one of SEQ ID NOs: 65, 67, 69, 71, 73, 75 or 77, variant polynucleotides of the polynucleotide shown in SEQ ID NO: 87 are shown in any one of SEQ ID NOs: 89, 91, 93, 95, 97, 99, 101, 103, 105, 107, 109, 111, 113, 115, 117, 119, 121, 123, 125, 127, 129, 131, 133, 135 or 137, variant polynucleotides of the polynucleotide shown in SEQ ID NO: 158 are shown in any one of SEQ ID NOs: 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226 or 228, variant polynucleotides of the polynucleotide shown in SEQ ID NO: 238 are shown in any one of SEQ ID NOs: 240, 242, 244, 246, 248, 250, 252, 254, 256, 258, 260, 262, 264 or 266, variant polynucleotides of the polynucleotide shown in SEQ ID NO: 273 are shown in any one of SEQ ID NOs: 275, 277, 279, 281, 283, 285, 287, 289, 291, 293, 295, 297, 299, 301, 303, 305, 307, 309, 311 or 313, variant polynucleotides of the polynucleotide shown in SEQ ID NO: 321 are shown in any one of SEQ ID NOs: 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519 or 521, variant polynucleotides of the polynucleotide shown in SEQ ID NO: 552 are shown in any one of SEQ ID NOs: 554, 556, 558, 560, 562, 564, 566, 568, 570, 572, 574, 576, 578, 580 or 582, variant polynucleotides of the polynucleotide shown in SEQ ID NO: 591 are shown in any one of SEQ ID NOs: 593, 595, 597, 599, 601, 603, 605, 607, 609, 611, 613 or 615, variant polynucleotides of the polynucleotide shown in SEQ ID NO: 625 are shown in any one of SEQ ID NOs: 627, 629, 631, 633 or 635, variant polynucleotides of the polynucleotide shown in SEQ ID NO: 657 are shown in any one of SEQ ID NOs: 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763 or 765, and variant polynucleotides of the polynucleotide shown in SEQ ID NO: 778 are shown in any one of SEQ ID NOs: 780, 782, 784, 786, 788, 790, 792, 794, 796, 798, 800, 802, 804 or 806.

The variant polynucleotides or fragments referred to above, preferably, encode polypeptides retaining at least 10%, at least 20%, at least 30%, at least 40%, at least 50%, at least 60%, at least 70%, at least 80% or at least 90% of the biological activity exhibited by the polypeptide shown in SEQ ID NO: 2, 4, 6, 8, 10, 12, 14, 16, 18, 20, 22, 24, 26, 28, 30, 32, 34, 36, 38, 40, 42, 44, 46, 48, 64, 66, 68, 70, 72, 74, 76, 78, 88, 90, 92, 94, 96, 98, 100, 102, 104, 106, 108, 110, 112, 114, 116, 118, 120, 122, 124, 126, 128, 130, 132, 134, 136, 138, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 241, 243, 245, 247, 249, 251, 253, 255, 257, 259, 261, 263, 265, 267, 274, 276, 278, 280, 282, 284, 286, 288, 290, 292, 294, 296, 298, 300, 302, 304, 306, 308, 310, 312, 314, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 553, 555, 557, 559, 561, 563, 565, 567, 569, 571, 573, 575, 577, 579, 581, 583, 592, 594, 596, 598, 600, 602, 604, 606, 608, 610, 612, 614, 616, 626, 628, 630, 632, 634, 636, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 779, 781, 783, 785, 787, 789, 791, 793, 795, 797, 799, 801, 803, 805 or 807. The activity may be tested as described in the accompanying Examples.

The polynucleotides of the present invention either essentially consist of the aforementioned nucleic acid sequences or comprise the aforementioned nucleic acid sequences. Thus, they may contain further nucleic acid sequences as well. Preferably, the polynucleotide of the present invention may comprise in addition to an open reading frame further untranslated sequence at the 3' and at the 5' terminus of the coding gene region: at least 500, preferably 200, more preferably 100 nucleotides of the sequence upstream of the 5' terminus of the coding region and at least 100, preferably 50, more preferably 20 nucleotides of the sequence downstream of the 3' terminus of the coding gene region. Furthermore, the polynucleotides of the present invention may encode fusion proteins wherein one partner of the fusion protein is a polypeptide being encoded by a nucleic acid sequence recited above. Such fusion proteins may comprise as additional part other enzymes of the fatty acid or lipid biosynthesis pathways, polypeptides for monitoring expression (e.g., green, yellow, blue or red fluorescent proteins, alkaline phosphatase and the like) or so called "tags" which may serve as a detectable marker or as an auxiliary measure for purification purposes. Tags for the different purposes are well known in the art and comprise FLAG-tags, 6-histidine-tags, MYC-tags and the like.

Variant polynucleotides as referred to in accordance with the present invention may be obtained by various natural as well as artificial sources. For example, polynucleotides may be obtained by in vitro and in vivo mutagenesis approaches using the above mentioned specific polynucleotides as a basis. Moreover, polynucleotides being homologs or orthologs may be obtained from various animal, plant, bacteria or fungus species. Paralogs may be identified from *Arabidopsis thaliana, Brassica napus* or *Glycine max.*

The polynucleotide of the present invention shall be provided, preferably, either as an isolated polynucleotide (i.e. isolated from its natural context such as a gene locus) or in genetically modified or exogenously (i.e. artificially) manipulated form. An isolated polynucleotide can, for example, comprise less than approximately 5 kb, 4 kb, 3 kb, 2 kb, 1 kb, 0.5 kb or 0.1 kb of nucleotide sequences which naturally flank the nucleic acid molecule in the genomic DNA of the cell from which the nucleic acid is derived. The polynucleotide, preferably, is double or single stranded DNA including cDNA or RNA. The term encompasses single- as well as double-stranded polynucleotides. Moreover, comprised are also chemically modified polynucleotides including naturally occurring modified polynucleotides such as glycosylated or methylated polynucleotides or artificial modified ones such as biotinylated polynucleotides. Further variant polynucleotides encompass peptide nucleic acids (PNAs). Such a PNA, preferably, comprises a peptide moiety chemically linked to a polynucleotide having a nucleic acid sequence of a polynucleotide of the present invention or a fragment thereof.

The polynucleotide encoding a polypeptide having a biological activity as specified encompassed by the present invention is also, preferably, a polynucleotide having a nucleic acid sequence which has been adopted to the specific codon-usage of the organism, e.g., the plant species, in which the polynucleotide shall be expressed (i.e. the target organism). This is, in general, achieved by changing the codons of a nucleic acid sequence obtained from a first organism (i.e. the donor organism) encoding a given amino acid sequence into the codons normally used by the target organism whereby the amino acid sequence is retained. It is in principle acknowledged that the genetic code is redundant (i.e. degenerated). Specifically, 61 codons are used to encode only 20 amino acids. Thus, a majority of the 20 amino acids will be encoded by more than one codon. The codons for the amino acids are well known in the art and are universal to all organisms. However, among the different codons which may be used to encode a given amino acid, each organism may preferably use certain codons. The presence of rarely used codons in a nucleic acid sequence will result a depletion of the respective tRNA pools and, thereby, lower the translation efficiency. Thus, it may be advantageous to provide a polynucleotide comprising a nucleic acid sequence encoding a polypeptide as referred to above wherein said nucleic acid sequence is optimized for expression in the target organism with respect to the codon usage. In order to optimize the codon usage for a target organism, a plurality of known genes from the said organism may be investigated for the most commonly used codons encoding the amino acids. In a subsequent step, the codons of a nuclei acid sequence from the donor organism will be optimized by replacing the codons in the donor sequence by the codons most commonly used by the target organism for encoding the same amino acids. It is to be understood that if the same codon is used preferably by both organisms, no replacement will be necessary. For various target organisms, tables with the preferred codon usages are already known in the art; see e.g., http://www.kazusa.or.jp/Kodon/E.html. Moreover, computer programs exist for the optimization, e.g., the Leto software, version 1.0 (Entelechon GmbH, Germany) or the GeneOptimizer (Geneart AG, Germany). For the optimization of a nucleic acid sequence, several criteria may be taken into account. For example, for a given amino acid, always the most commonly used codon may be selected for each codon to be exchanged. Alternatively, the codons used by the target organism may replace those in a donor sequence according to their naturally frequency. Accordingly, at some positions even less commonly used codons of the target organism will appear in the optimized nucleic acid sequence. The distribution of the different replacement codons of the target organism to the donor nucleic acid sequence may be randomly. Preferred target organisms in accordance with the present invention are soybean or canola (Brassica) species. Preferably, the polynucleotide of the present invention has an optimized nucleic acid for codon usage in the envisaged target organism wherein at least 20%, at least 40%, at least 60%, at least 80% or all of the relevant codons are adopted.

Advantageously, it has been found in the studies underlying the present invention that the polypeptides being encoded by the polynucleotides of the present invention are capable of increasing the content of seed storage compounds and, in particular, of lipids or fatty acids, in plants. Thus, the polynucleotides of the present invention are, in principle, useful for the synthesis of seed storage compounds such as fatty acids or lipids. Moreover, they may be used to generate transgenic plants or seeds thereof having a modified, preferably increased, amount of seed storage compounds. Such transgenic plants or seeds may be used for the manufacture of seed oil or other lipid and/or fatty acid containing compositions.

Further, the present invention relates to a vector comprising the polynucleotide of the present invention. Preferably, the vector is an expression vector.

The term "vector", preferably, encompasses phage, plasmid, viral or retroviral vectors as well as artificial chromosomes, such as bacterial or yeast artificial chromosomes. Moreover, the term also relates to targeting constructs which allow for random or site-directed integration of the targeting construct into genomic DNA. Such target constructs, preferably, comprise DNA of sufficient length for either homolgous recombination or heterologous insertion as described in detail below. The vector encompassing the polynucleotides of the present invention, preferably, further comprises selectable markers for propagation and/or selection in a host. The vector may be incorporated into a host cell by various techniques well known in the art. If introduced into a host cell, the vector may reside in the cytoplasm or may be incorporated into the genome. In the latter case, it is to be understood that the vector may further comprise nucleic acid sequences which allow for homologous recombination or heterologous insertion, see below. Vectors can be introduced into prokaryotic or eukaryotic cells via conventional transformation or transfection techniques. An "expression vector" according to the present invention is characterized in that it comprises an expression control sequence such as promoter and/or enhancer sequence operatively linked to the polynucleotide of the present invention. Preferred vectors, expression vectors and transformation or transfection techniques are specified elsewhere in this specification in detail.

Furthermore, the present invention encompasses a host cell comprising the polynucleotide or vector of the present invention.

Host cells are primary cells or cell lines derived from multicellular organisms such as plants or animals. Furthermore, host cells encompass prokaryotic or eukaryotic single cell organisms (also referred to as microorganisms), e.g. bacteria or fungi including yeast or bacteria. Primary cells or cell lines to be used as host cells in accordance with the present invention may be derived from the multicellular organisms, preferably from plants. Specifically preferred host cells, microorganisms or multicellular organism from which host cells may be obtained are disclosed below.

The polynucleotides or vectors of the present invention may be incorporated into a host cell or a cell of a transgenic non-human organism by heterologous insertion or homologous recombination. "Heterologous" as used in the context of the present invention refers to a polynucleotide which is inserted (e.g., by ligation) or is manipulated to become inserted to a nucleic acid sequence context which does not naturally encompass the said polynucleotide, e.g., an artificial nucleic acid sequence in a genome of an organism. Thus, a heterologous polynucleotide is not endogenous to the cell into which it is introduced, but has been obtained from another cell. Generally, although not necessarily, such heterologous polynucleotides encode proteins that are normally not produced by the cell expressing the said heterologous polynucleotide. An expression control sequence as used in a targeting construct or expression vector is considered to be "heterologous" in relation to another sequence (e.g., encoding a marker sequence or an agronomically relevant trait) if said two sequences are either not combined or operatively linked in a different way in their natural environment. Preferably, said sequences are not operatively linked in their natural environment (i.e. originate from different genes). Most preferably, said regulatory sequence is covalently joined (i.e. ligated) and adjacent to a nucleic acid to which it is not adjacent in its natural environment. "Homologous" as used in accordance with the present invention relates to the insertion of a polynucleotide in the sequence context in which the said polynucleotide naturally occurs. Usually, a heterologous polynucleotide is also incorporated into a cell by homologous recombination. To this end, the heterologous polynucleotide is flanked by nucleic acid sequences being homologous to a target sequence in the genome of a host cell or a non-human organism. Homologous recombination now occurs between the homologous sequences. However, as a result of the homologous recombination of the flanking sequences, the heterologous polynucleotide will be inserted, too. How to prepare suitable target constructs for homologous recombination and how to carry out the said homologous recombination is well known in the art.

Also provided in accordance with the present invention is a method for the manufacture of a polypeptide being capable of increasing the seed storage compound content when expressed in transgenic plants comprising:
(a) expressing the polynucleotide of the present invention in a host cell; and
(b) obtaining the polypeptide encoded by said polynucleotide from the host cell.

The polypeptide may be obtained, for example, by all conventional purification techniques including affinity chromatography, size exclusion chromatography, high pressure liquid chromatography (HPLC) and precipitation techniques including antibody precipitation. It is to be understood that the method may—although preferred—not necessarily yield an essentially pure preparation of the polypeptide. It is to be understood that depending on the host cell which is used for the aforementioned method, the polypeptides produced thereby may become posttranslationally modified or processed otherwise.

The present invention, moreover, pertains to a polypeptide encoded by the polynucleotide of the present invention or which is obtainable by the aforementioned method of the present invention.

The term "polypeptide" as used herein encompasses essentially purified polypeptides or polypeptide preparations comprising other proteins in addition. Further, the term also relates to the fusion proteins or polypeptide fragments being at least partially encoded by the polynucleotide of the present invention referred to above. Moreover, it includes chemically modified polypeptides. Such modifications may be artificial modifications or naturally occurring modifications such as phosphorylation, glycosylation, myristylation and the like. The terms "polypeptide", "peptide" or "protein" are used interchangeable throughout this specification. The polypeptide of the present invention shall exhibit the biological activities referred to above and, more preferably, it shall be capable of increasing the amount of seed storage compounds, preferably, fatty acids or lipids, when present in plant seeds as referred to above. Most preferably, if present in plant seeds, the polypeptide shall be capable of significantly increasing the seed storage of fatty acids as described in the accompanying Examples below.

Encompassed by the present invention is, furthermore, an antibody which specifically recognizes the polypeptide of the invention.

Antibodies against the polypeptides of the invention can be prepared by well known methods using a purified polypeptide according to the invention or a suitable fragment derived therefrom as an antigen. A fragment which is suitable as an antigen may be identified by antigenicity determining algorithms well known in the art. Such fragments may be obtained either from the polypeptide of the invention by proteolytic digestion or may be a synthetic peptide. Preferably, the antibody of the present invention is a monoclonal antibody, a polyclonal antibody, a single chain antibody, a human or humanized antibody or primatized, chimerized or fragment thereof. Also comprised as antibodies by the present invention are a bispecific antibody, a synthetic antibody, an antibody fragment, such as Fab, Fv or scFv fragments etc., or a chemically modified derivative of any of these. The antibody of the present invention shall specifically bind (i.e. does significantly not cross react with other polypeptides or peptides) to the polypeptide of the invention. Specific binding can be tested by various well known techniques. Antibodies or fragments thereof can be obtained by using methods which are described, e.g., in Harlow and Lane "Antibodies, A Laboratory Manual", CSH Press, Cold Spring Harbor, 1988. Monoclonal antibodies can be prepared by the techniques originally described in Köhler and Milstein, Nature 256 (1975), 495, and Galfré, Meth. Enzymol. 73 (1981), 3, which comprise the fusion of mouse myeloma cells to spleen cells derived from immunized mammals. The antibodies can be used, for example, for the immunoprecipitation, immunolocalization or purification (e.g., by affinity chromatography) of the polypeptides of the invention as well as for the monitoring of the presence of said variant polypeptides, for example, in recombinant organisms, and for the identification of compounds interacting with the proteins according to the invention.

The present invention also relates to a transgenic non-human organism comprising the polynucleotide, the vector or the host cell of the present invention. Preferably, said non-human transgenic organism is a plant.

The term "non-human transgenic organism", preferably, relates to a plant, an animal or a multicellular microorganism. The polynucleotide or vector may be present in the cytoplasm of the organism or may be incorporated into the genome either heterologous or by homologous recombination. Host cells, in particular those obtained from plants or animals, may be introduced into a developing embryo in order to obtain mosaic or chimeric organisms, i.e. non-human transgenic organisms comprising the host cells of the present invention. Preferably, the non-human transgenic organism expresses the polynucleotide of the present invention in order to produce the polypeptide in an amount resulting in a detectable biological activity as specified above. Suitable transgenic organisms are, preferably, all those organisms which are capable of synthesizing fatty acids or lipids. Preferred organisms and methods for transgenesis are disclosed in detail below. A transgenic organism or tissue may comprise one or more transgenic cells. Preferably, the organism or tissue is substantially consisting of transgenic cells (i.e., more than 80%, preferably 90%, more preferably 95%, most preferably 99% of the cells in said organism or tissue are transgenic). The term "transgene" as used herein refers to any nucleic acid sequence, which is introduced into the genome of a cell or which has been manipulated by experimental manipulations including techniques such as chimeraplasty or genoplasty. Preferably, said sequence is resulting in a genome which is significantly different from the overall genome of an organism (e.g., said sequence, if endogenous to said organism, is introduced into a location different from its natural location, or its copy number is increased or decreased). A transgene may comprise an endogenous polynucleotide (i.e. a polynucleotide having a nucleic acid sequence obtained from the same organism or host cell) or may be obtained from a different organism or hast cell, wherein said different organism is, preferably an organism of another species and the said different host cell is, preferably, a different microorganism, a host cell of a different origin or derived from a an organism of a different species.

Particularly preferred as a plant to be used in accordance with the present invention are oil producing plant species. Most preferably, the said plant is selected from the group consisting of canola, linseed, soybean, sunflower, maize, oat, rye, barley, wheat, rice, pepper, tagetes, cotton, oil palm, coconut palm, flax, castor and peanut, The present invention relates to a method for the manufacture of a lipid and/or a fatty acid comprising the steps of:
(a) cultivating (i) the host cell or the transgenic non-human organism of the present invention or (ii) a host cell or a non-human transgenic organism comprising a polynucleotide comprising a nucleic acid sequence as shown in any one of SEQ ID NO: 139, 141, 143, 145, 147, 523, 525, 527, 529, 531, 533, 535, 537, 539, 584, 617, 619, 637, 639, 641, 767, 769, 808, 810, 812 or 814 or encoding an amino acid sequence as shown in any one of SEQ ID NOs: 140, 142, 144, 146, 148, 524, 526, 528, 530, 532, 534, 536, 538, 540, 585, 618, 620, 638, 640, 642, 768, 770, 809, 811, 813 or 815 under conditions allowing synthesis of the said lipid or fatty acid; an
(b) obtaining the said lipid and/or fatty acid from the host cell or the transgenic non-human organism.

The term "lipid" and "fatty acid" as used herein refer, preferably, to those recited in Table 13 (for lipids) and Table 14 (for fatty acids), below. However, the terms, in principle, also encompass other lipids or fatty acids which can be obtained by the lipid metabolism in a host cell or an organism referred to in accordance with the present invention.

A host cell or a non-human transgenic organism expressing a polynucleotide comprising a nucleic acid sequence as shown in SEQ ID NO: 139, 141, 143, 145, 147, 523, 525, 527, 529, 531, 533, 535, 537, 539, 584, 617, 619, 637, 639, 641, 767, 769, 808, 810, 812 or 814 can be obtained by any of the insertion or recombination techniques referred to elsewhere in this specification. It is, preferably, envisaged that the polynucleotide is a heterologous polynucleotide with respect to the host cell or the non-human organism. The polynucleotides comprising a nucleic acid sequence as shown in SEQ ID NO: 139, 141, 143, 145, 147, 523, 525, 527, 529, 531, 533, 535, 537, 539, 584, 617, 619, 637, 639, 641, 767, 769, 808, 810, 812 or 814 encode a polypeptide having an amino acid sequence as shown in SEQ ID NO: 140, 142, 144, 146, 148, 524, 526, 528, 530, 532, 534, 536, 538, 540, 585, 618, 620, 638, 640, 642, 768, 770, 809, 811, 813 or 815. These sequences represent distantly related homologs. However, it has been found that these sequences are also capable to modify and, preferably, increase the amount of seed storage compounds in plants. Accordingly, these polynucleotides as well as variants may be also used in the methods of the present invention although less efficiently. The definition of the term "variant" made in connection with the polynucleotides of the present invention applies mutatis mutandis for the variants of the aforementioned polynucleotides (i.e. SEQ ID NOs: 139, 141, 143, 145, 147, 523, 525, 527, 529, 531, 533, 535, 537, 539, 584, 617, 619, 637, 639, 641, 767, 769, 808, 810, 812 or 814).

In a preferred embodiment of the aforementioned method of the present invention, the said lipid and/or fatty acids constitute seed oil.

Moreover, the present invention pertains to a method for the manufacture of a plant having a modified amount of a seed storage compound, preferably a lipid or a fatty acid, comprising the steps of:
(a) introducing (i) the polynucleotide or the vector of the present invention or (ii) a polynucleotide comprising a nucleic acid sequence as shown in any one of SEQ ID NO: 139, 141, 143, 145, 147, 523, 525, 527, 529, 531, 533, 535, 537, 539, 584, 617, 619, 637, 639, 641, 767, 769, 808, 810, 812 or 814 or encoding an amino acid sequence as shown in any one of SEQ ID NOs: 140, 142, 144, 146, 148, 524, 526, 528, 530, 532, 534, 536, 538, 540, 585, 618, 620, 638, 640, 642, 768, 770, 809, 811, 813 or 815 into a plant cell; and
(b) generating a transgenic plant from the said plant cell, wherein the polypeptide encoded by the polynucleotide modifies the amount of the said seed storage compound in the transgenic plant.

The term "seed storage compound" as used herein, preferably, refers to compounds being a sugar, a protein, or, more preferably, a lipid or a fatty acid. Preferably, the amount of said seed storage compound is significantly increased compared to a control, preferably an empty vector control as specified above. The increase is, more preferably, an increase in the amount by weight of at least 1, 2.5, 5, 7.5, 10, 12.5, 15, 17.5, 20, 22.5 or 25% as compared to a control.

It is to be understood that the polynucleotides or the vector referred to in accordance with the above method of the present invention may be introduced into the plant cell by any of the aforementioned insertion or recombination techniques.

The aforementioned method of the present invention may be also used to manufacture a plant having an altered total oil content in its seeds or a plant having an altered total seed oil content and altered levels of seed storage compounds in its seeds. Such plants are suitable sources for seed oil and may be used for the large scale manufacture thereof.

Further preferred embodiments of the compounds, methods and uses according to the present invention are described in the following. Moreover, the terms used above will be explained in more detail. The polynucleotides and polypeptides of the present invention are also referred to as Lipid Metabolism proteins (LMP) herein below.

The present invention also provides an isolated nucleic acid from *Arabidopsis thaliana* encoding a Lipid Metabolism Protein (LMP), or a portion thereof. These sequences may be used to modify or increase lipids and fatty acids, cofactors, and enzymes in microorganisms and plants.

*Arabidopsis* plants are known to produce considerable amounts of fatty acids, like linoleic and linolenic acid (see, e.g., Table 14), and for their close similarity in many aspects (gene homology etc.) to the oil crop plant *Brassica*. Therefore, nucleic acid molecules originating from a plant like *Arabidopsis thaliana, Brassica napus, Glycine max, Zea mays, Oryza sativa, Hordeum vulgare, Linum usitatissimum, Triticum aestivum, Helianthus anuus, Beta vulgaris*, or *Physcomitrella patens*, or related organisms, are especially suited to modify the lipid and fatty acid metabolism in a host, especially in microorganisms and plants. Furthermore, nucleic acids from the plant *Arabidopsis thaliana, Brassica napus, Glycine max, Zea mays, Oryza sativa, Hordeum vulgare, Linum usitatissimum, Triticum aestivum, Helianthus anuus, Beta vulgaris* or *Physcomitrella patens*, or related organisms, can be used to identify those DNA sequences and enzymes in other species, which are useful to modify the biosynthesis of precursor molecules of fatty acids in the respective organisms.

The present invention further provides an isolated nucleic acid comprising a fragment of at least 15 nucleotides of a nucleic acid from a plant (*Arabidopsis thaliana*) encoding an LMP or a portion thereof.

The present invention, thus, also encompasses an oligonucleotide which specifically binds to the polynucleotides of the present invention. Binding as meant in this context refers to hybridization by Watson-Crick base pairing discussed elsewhere in the specification in detail. An oligonucleotide as used herein has a length of at most 100, at most 50, at most 40, at most 30 or at most 20 nucleotides in length which are complementary to the nucleic acid sequence of the polynucleotides of the present invention. The sequence of the oligonucleotide is, preferably, selected so that a perfect match by Watson-Crick base pairing will be obtained. The oligonucleotides of the present invention may be suitable as primers for PCR-based amplification techniques. Moreover, the oligonucleotides may be used for RNA interference (RNAi) approaches in order to modulate and, preferably down-regulate, the activity of the polypeptides encoded by the polynucleotides of the present invention. Thereby, an organism may be depleted of fatty acids and/or lipids and, specifically, a plant seed may be depleted of at least some of its seed storage compounds. As used herein, the term "RNA interference (RNAi)" refers to selective intracellular degradation of RNA used to silence expression of a selected target gene, i.e. the polynucleotide of the present invention. RNAi is a process of sequence-specific, post-transcriptional gene silencing in organisms initiated by double-stranded RNA (dsRNA) that is homologous in sequence to the gene to be silenced. The RNAi technique involves small interfering RNAs (siRNAs) that are complementary to target RNAs (encoding a gene of interest) and specifically destroy the known mRNA, thereby diminishing or abolishing gene expression. RNAi is generally used to silence expression of a gene of interest by targeting mRNA, however, any type of RNA is encompassed by the RNAi methods of the invention. Briefly, the process of RNAi in the cell is initiated by long double stranded RNAs (dsRNAs) being cleaved by a ribonuclease, thus producing siRNA duplexes. The siRNA binds to another intracellular enzyme complex which is thereby activated to target whatever mRNA molecules are homologous (or complementary) to the siRNA sequence. The function of the complex is to target the homologous mRNA molecule through base pairing interactions between one of the siRNA strands and the target mRNA. The mRNA is then cleaved approximately 12 nucleotides from the 3' terminus of the siRNA and degraded. In this manner, specific mRNAs can be targeted and degraded, thereby resulting in a loss of protein expression from the targeted mRNA. A complementary nucleotide sequence as used herein refers to the region on the RNA strand that is complementary to an RNA transcript of a portion of the target gene. The term "dsRNA" refers to RNA having a duplex structure comprising two complementary and anti-parallel nucleic acid strands. Not all nucleotides of a dsRNA necessarily exhibit complete Watson-Crick base pairs; the two RNA strands may be substantially complementary. The RNA strands forming the dsRNA may have the same or a different number of nucleotides, with the maximum number of base pairs being the number of nucleotides in the shortest strand of the dsRNA. Preferably, the dsRNA is no more than 49, more preferably less than 25, and most preferably between 19 and 23, nucleotides in length. dsRNAs of this length are particularly efficient in inhibiting the expression of the target gene using RNAi techniques. dsRNAs are subsequently degraded by a ribonuclease enzyme into short interfering RNAs (siRNAs). RNAi is mediated by small interfering RNAs (siRNAs). The term "small interfering RNA" or "siRNA" refers to a nucleic acid molecule which is a double stranded RNA agent that is complementary to i.e., able to base-pair with, a portion of a target RNA (generally mRNA), i.e. the polynucleotide of the present invention being RNA. siRNA acts to specifically guide enzymes in the host cell to cleave the target RNA. By virtue of the specificity of the siRNA sequence and its homology to the RNA target, siRNA is able to cause cleavage of the target RNA strand, thereby inactivating the target RNA molecule. Preferably, the siRNA which is sufficient to mediate RNAi comprises a nucleic acid sequence comprising an inverted repeat fragment of the target gene and the coding region of the gene of interest (or portion thereof). Also preferably, a nucleic acid sequence encoding a siRNA comprising a sequence sufficiently complementary to a target gene is operatively linked to a expression control sequence. Thus, the mediation of RNAi to inhibit expression of the target gene can be modulated by said expression control sequence. Preferred expression control sequences are those which can be regulated by a exogenous stimulus, such as the tet operator whose activity can be regulated by tetracycline or heat inducible promoters. Alternatively, an expression control sequence may be used which allows tissue-specific expression of the siRNA. The complementary regions of the siRNA allow sufficient hybridization of the siRNA to the target RNA and thus mediate RNAi. In mammalian cells, siRNAs are approximately 21-25 nucleotides in length (see Tuschl et al. 1999 and Elbashir et al. 2001). The siRNA sequence needs to be of sufficient length to bring the siRNA and target RNA together through complementary base-pairing interactions. The siRNA used with the Tet expression system of the invention may be of varying lengths. The length of the siRNA is preferably greater than or equal to ten nucleotides and of sufficient length to stably interact with the target RNA; specifically 15-30 nucleotides; more specifically any integer between 15 and 30 nucleotides, most preferably 15, 16, 17, 18, 19, 20, 21, 22, 23, 24, 25, 26, 27, 28, 29, and 30. By "sufficient length" is meant an oligonucleotide of greater than or equal to 15 nucleotides that is of a length great enough to provide the intended function under the expected condition. By "stably interact" is meant interaction of the small interfering RNA with target nucleic acid (e.g., by forming hydrogen bonds with complementary nucleotides in the target under physiological conditions). Generally, such complementarity is 100% between the siRNA and the RNA target, but can be less if desired, preferably 91%, 92%, 93%, 94%, 95%, 96%, 97%, 98%, or 99%. For example, 19 bases out of 21 bases may be base-paired. In some instances, where selection between various allelic variants is desired, 100% complementary to the target gene is required in order to effectively discern the target sequence from the other allelic sequence. When selecting between allelic targets, choice of length is also an important factor because it is the other factor involved in the percent complementary and the ability to differentiate between allelic differences. Methods relating to the use of RNAi to silence genes in organisms, including *C. elegans*, *Drosophila*, plants, and mammals, are known in the art (see, for example, Fire et al., Nature (1998) 391:806-811; Fire, Trends Genet. 15, 358-363 (1999); Sharp, RNA interference 2001. Genes Dev. 15, 485-490 (2001); Hammond et al. Nature Rev. Genet. 2, 1110-1119 (2001); Tuschl, Chem. Biochem. 2, 239-245 (2001); Hamilton et al., Science 286, 950-952 (1999); Hammond et al., Nature 404, 293-296 (2000); Zamore et al., Cell 101, 25-33 (2000); Bernstein et al., Nature 409, 363-366 (2001); Elbashir et al., Genes Dev. 15, 188-200 (2001); WO 0129058; WO 09932619; and Elbashir et al., 2001 Nature 411: 494-498).

Also provided by the present invention are polypeptides encoded by the nucleic acids, and heterologous polypeptides comprising polypeptides encoded by the nucleic acids, and antibodies to those polypeptides.

Additionally, the present invention relates to, and provides the use of, LMP nucleic acids in the production of transgenic plants having a modified level or composition of a seed storage compound. In regard to an altered composition, the present invention can be used, for example, to increase the percentage of oleic acid relative to other plant oils. A method of producing a transgenic plant with a modified level or composition of a seed storage compound includes the steps of transforming a plant cell with an expression vector comprising an LMP nucleic acid and generating a plant with a modified level or composition of the seed storage compound from the plant cell. In a preferred embodiment, the plant is an oil-producing species selected from the group consisting of, for example, canola, linseed, soybean, sunflower, maize, oat, rye, barley, wheat, rice, pepper, tagetes, cotton, oil palm, coconut palm, flax, castor, and peanut.

According to the present invention, the compositions and methods described herein can be used to alter the composition of an LMP in a transgenic plant and to increase or decrease the level of an LMP in a transgenic plant comprising increasing or decreasing the expression of an LMP nucleic acid in the plant. Increased or decreased expression of the LMP nucleic acid can be achieved through transgenic overexpression, co-suppression approaches, antisense approaches, and in vivo mutagenesis of the LMP nucleic acid. The present invention can also be used to increase or decrease the level of a lipid in a seed oil, to increase or decrease the level of a fatty acid in a seed oil, or to increase or decrease the level of a starch in a seed or plant.

More specifically, the present invention includes, and provides a method for, altering (increasing or decreasing or changing the specific profile of) the total oil content in a seeds comprising: Transforming a plant with a nucleic acid construct that comprises, as operably-linked components, a promoter and nucleic acid sequences capable of modulating the level of LMP mRNA or LMP protein, and growing the plant. Furthermore, the present invention includes, and provides a method for, altering (increasing or decreasing) the level of oleic acid in a seed comprising: Transforming a plant with a nucleic acid construct that comprises as operably linked components, a promoter, a structural nucleic acid sequence capable of altering (increasing or decreasing) the level of oleic acid, and growing the plant.

Also included herein is a seed produced by a transgenic plant transformed by an LMP DNA sequence, wherein the seed contains the LMP DNA sequence, and wherein the plant is true breeding for a modified level of a seed-storage compound. The present invention additionally includes a seed oil produced by the aforementioned seed.

Further provided by the present invention are vectors comprising the nucleic acids, host cells containing the vectors, and descendent plant materials produced by transforming a plant cell with the nucleic acids and/or vectors.

According to the present invention, the compounds, compositions, and methods described herein can be used to increase or decrease the relative percentages of a lipid in a seed oil, increase or decrease the level of a lipid in a seed oil, or to increase or decrease the level of a fatty acid in a seed oil, or to increase or decrease the level of a starch or other carbohydrate in a seed or plant, or to increase or decrease the level of proteins in a seed or plant. The manipulations described herein can also be used to improve seed germination and growth of the young seedlings and plants and to enhance plant yield of seed storage compounds.

It is further provided a method of producing a higher or lower than normal or typical level of storage compound in a transgenic plant expressing an LMP nucleic acid from *Arabidopsis thaliana*, *Brassica napus*, *Glycine max* and *Oryza sativa* in the transgenic plant, wherein the transgenic plant is *Arabidopsis thaliana*, *Brassica napus*, *Glycine max*, *Oryza sativa*, *Zea mays*, *Triticum aestivum*, *Hordeum vulgare*, *Linum usitatissimum*, *Helianthus anuus*, or *Beta vulgaris* or a species different from *Arabidopsis thaliana*, *Brassica napus*, *Glycine max* and *Oryza sativa*. Also included herein are compositions and methods of the modification of the efficiency of production of a seed storage compound. As used herein, where the phrase *Arabidopsis thaliana*, *Brassica napus*, *Glycine max*, *Oryza sativa*, *Zea mays*, *Triticum aestivum*, *Hordeum vulgare*, *Linum usitatissimum*, *Helianthus anuus*, or *Beta vulgaris* is used, this also means *Arabidopsis thaliana* and/or *Brassica napus* and/or *Glycine max* and/or *Oryza sativa* and/or *Zea mays* and/or *Triticum aestivum* and/or *Hordeum vulgare* and/or *Linum usitatissimum* and/or *Helianthus anuus* and/or *Beta vulgaris*.

Accordingly, it is an object of the present invention to provide novel isolated LMP nucleic acids and isolated LMP amino acid sequences from *Arabidopsis thaliana*, *Brassica napus*, *Glycine max* and *Oryza sativa*, as well as active fragments, analogs, and orthologs thereof. Those active fragments, analogs, and orthologs can also be from different plant species, as one skilled in the art will appreciate that other plant species will also contain those or related nucleic acids.

It is another object of the present invention to provide transgenic plants having modified levels of seed storage compounds, and, in particular, modified levels of a lipid, a fatty acid, or a sugar.

The polynucleotides and polypeptides of the present invention, including agonists and/or fragments thereof, have also uses that include modulating plant growth, and potentially plant yield, preferably increasing plant growth under adverse conditions (drought, cold, light, UV). In addition, antagonists of the present invention may have uses that include modulating plant growth and/or yield through preferably increasing plant growth and yield. In yet another embodiment, over-expression polypeptides of the present invention, using a constitutive promoter, may be useful for increasing plant yield under stress conditions (drought, light, cold, UV) by modulating light-utilization efficiency. Moreover, polynucleotides and polypeptides of the present invention will improve seed germination and seed dormancy and, hence, will improve plant growth and/or yield of seed storage compounds.

The isolated nucleic acid molecules of the present invention may further comprise an operably linked promoter or partial promoter region. The promoter can be a constitutive promoter, an inducible promoter, or a tissue-specific promoter. The constitutive promoter can be, for example, the superpromoter (Ni et al., Plant J. 7:661-676, 1995; U.S. Pat. No. 5,955,646). The tissue-specific promoter can be active in vegetative tissue or reproductive tissue. The tissue-specific promoter active in reproductive tissue can be a seed-specific promoter. The tissue-specific promoter active in vegetative tissue can be a root-specific, shoot-specific, meristem-specific, or leaf-specific promoter. The isolated nucleic acid molecule of the present invention can still further comprise a 5' non-translated sequence, 3' non-translated sequence, introns, or the combination thereof.

The present invention also provides a method for increasing the number and/or size or density of one or more plant organs of a plant expressing an isolated nucleic acid from *Arabidopsis thaliana, Brassica napus, Glycine max* and *Oryza sativa* encoding a LMP, or a portion thereof. More specifically, seed size, and/or seed number and/or weight, might be manipulated. Moreover, root length or density can be increased. Longer or denser roots can alleviate not only the effects of water depletion from soil but also improve plant anchorage/standability, thus reducing lodging. Also, longer or denser roots have the ability to cover a larger volume of soil and improve nutrient uptake. All of these advantages of altered root architecture have the potential to increase crop yield. Additionally, the number and size of leaves might be increased by the nucleic acid sequences provided in this application. This will have the advantage of improving photosynthetic light-utilization efficiency by increasing photosynthetic light-capture capacity and photosynthetic efficiency.

It is a further object of the present invention to provide methods for producing such aforementioned transgenic plants.

It is another object of the present invention to provide seeds and seed oils from such aforementioned transgenic plants.

Before the present compounds, compositions, and methods are disclosed and described, it is to be understood that this invention is not limited to specific nucleic acids, specific polypeptides, specific cell types, specific host cells, specific conditions, or specific methods, etc., as such may, of course, vary, and the numerous modifications and variations therein will be apparent to those skilled in the art. It is also to be understood that the terminology used herein is for the purpose of describing particular embodiments only and is not intended to be limiting. As used in the specification and in the claims, "a" or "an" can mean one or more, depending upon the context in which it is used. Thus, for example, reference to "a cell" can mean that at least one cell can be utilized.

The present invention is based, in part, on the isolation and characterization of nucleic acid molecules encoding LMPs from plants including *Arabidopsis thaliana, Brassica napus, Glycine max, Oryza sativa*, and other related crop species like maize, wheat, rice, barley, linseed, sugar beat, or sunflower.

In accordance with the purpose(s) of this invention, as embodied and broadly described herein, this invention, in one aspect, provides an isolated nucleic acid from a plant (*Arabidopsis thaliana, Brassica napus, Glycine max*, or *Oryza sativa*) encoding a LMP or a portion thereof.

One aspect of the invention pertains to isolated nucleic acid molecules that encode the LMP polypeptides of the present invention, or biologically active portions thereof, as well as nucleic acid fragments sufficient for use as hybridization probes or primers for the identification or amplification of an LMP-encoding nucleic acid (e.g., LMP DNA). As used herein, the term "nucleic acid molecule" is intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of a gene: At least about 1000 nucleotides of sequence upstream from the 5' end of the coding region and at least about 200 nucleotides of sequence downstream from the 3' end of the coding region of the gene. The nucleic acid molecule can be single-stranded or double-stranded, but preferably is double-stranded DNA. An "isolated" nucleic acid molecule is one that is substantially separated from other nucleic acid molecules, which are present in the natural source of the nucleic acid. Preferably, an "isolated" nucleic acid is substantially free of sequences that naturally flank the nucleic acid (i.e., sequences located at the 5' and 3' ends of the nucleic acid) in the genomic DNA of the organism from which the nucleic acid is derived. For example, in various embodiments, the isolated LMP nucleic acid molecule can contain less than about 5 kb, 4 kb, 3 kb, 2 kb, 1 kb, 0.5 kb, or 0.1 kb of nucleotide sequences, which naturally flank the nucleic acid molecule in genomic DNA of the cell from which the nucleic acid is derived (e.g., an *Arabidopsis thaliana, Brassica napus, Glycine max, Oryza sativa* cell). Moreover, an "isolated" nucleic acid molecule, such as a cDNA molecule, can be substantially free of other cellular material, or culture medium, when produced by recombinant techniques or chemical precursors, or other chemicals when chemically synthesized.

A nucleic acid molecule of the present invention, e.g., a nucleic acid molecule having a nucleotide sequence as specified elsewhere in the description, or a portion thereof, can be isolated using standard molecular biology techniques and the sequence information provided herein. For example, an *Arabidopsis thaliana, Brassica napus, Glycine max* or *Oryza sativa* LMP cDNA can be isolated from an *Arabidopsis thaliana, Brassica napus, Glycine max* or *Oryza sativa* library using all or portion of one of the specific sequences disclosed herein as a hybridization probe and standard hybridization techniques (e.g., as described in Sambrook et al. 1989, *Molecular Cloning: A Laboratory Manual.* 2nd, ed., Cold Spring Harbor Laboratory, Cold Spring Harbor Laboratory Press, Cold Spring Harbor, N.Y.). Moreover, a nucleic acid molecule encompassing all or a portion of one of the specific sequences disclosed herein can be isolated by the polymerase chain reaction using oligonucleotide primers designed based upon this sequence (e.g., a nucleic acid molecule encompassing all or a portion of one of the specific sequences disclosed herein can be isolated by the polymerase chain reaction using oligonucleotide primers designed based upon this same sequence). For example, mRNA can be isolated from plant cells (e.g., by the guanidinium-thiocyanate extraction procedure of Chirgwin et al. 1979, Biochemistry 18:5294-5299) and cDNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the specific sequences disclosed herein. A nucleic acid of the invention can be amplified using cDNA or, alternatively, genomic DNA, as a template and appropriate oligonucleotide primers according to standard PCR amplification techniques.

The nucleic acid so amplified can be cloned into an appropriate vector and characterized by DNA sequence analysis. Furthermore, oligonucleotides corresponding to an LMP nucleotide sequence can be prepared by standard synthetic techniques, e.g., using an automated DNA synthesizer.

In a preferred embodiment, an isolated nucleic acid of the invention comprises one of the nucleotide sequences referred to above. The specific sequences disclosed herein correspond to the *Arabidopsis thaliana, Brassica napus, Glycine max* and *Oryza sativa* LMP cDNAs of the invention. These cDNAs comprise sequences encoding LMPs (i.e., the "coding region", indicated in the table below), as well as 5' untranslated sequences and 3' untranslated sequences. Alternatively, the nucleic acid molecules can comprise only the coding region of any of the specific sequences disclosed herein or can contain whole genomic fragments isolated from genomic DNA.

For the purposes of this application, it will be understood that each of the specific sequences set forth herein has an identifying entry number (e.g., pk321AT01). Each of these sequences may generally comprise three parts: a 5' upstream region, a coding region, and a downstream region. A coding region of these sequences is indicated as "ORF position" (Table 15).

In another preferred embodiment, an isolated nucleic acid molecule of the invention comprises a nucleic acid molecule, which is a complement of one of the specific nucleotide sequences disclosed herein. A nucleic acid molecule, which is complementary to one of the nucleotide sequences is one which is sufficiently complementary to the said nucleotide sequence such that it can hybridize by forming a stable duplex.

In still another preferred embodiment, an isolated nucleic acid molecule of the invention comprises a nucleotide sequence that is at least about 50-60%, preferably at least about 60-70%, more preferably at least about 70-80%, 80-90%, or 90-95%, and even more preferably at least about 95%, 96%, 97%, 98%, 99%, or more homologous to a nucleotide sequence of the present invention, or a portion thereof. In an additional preferred embodiment, an isolated nucleic acid molecule of the invention comprises a nucleotide sequence that hybridizes, e.g., hybridizes under stringent conditions, to one of the nucleotide sequences of the present invention, or a portion thereof. These hybridization conditions include washing with a solution having a salt concentration of about 0.02 molar at pH 7 at about 60° C.

Moreover, the nucleic acid molecule of the invention can comprise only a portion of the coding region of one of the sequences of the present invention, for example, a fragment that can be used as a probe or primer, or a fragment encoding a biologically-active portion of an LMP. The nucleotide sequences determined from the cloning of the LMP genes from *Arabidopsis thaliana, Brassica napus, Glycine max* and *Oryza sativa* allows for the generation of probes and primers designed for use in identifying and/or cloning LMP homologues in other cell types and organisms, as well as LMP homologues from other plants or related species. Therefore, this invention also provides compounds comprising the nucleic acids disclosed herein or fragments thereof. These compounds include the nucleic acids attached to a moiety. These moieties include, but are not limited to, detection moieties, hybridization moieties, purification moieties, delivery moieties, reaction moieties, binding moieties, and the like. The probe/primer typically comprises substantially purified oligonucleotide. The oligonucleotide typically comprises a region of nucleotide sequence that hybridizes under stringent conditions to at least about 12, preferably about 25, more preferably about 40, 50 or 75 consecutive nucleotides of a sense strand of one of the sequences set forth herein, an anti-sense sequence of one of the sequences set forth in herein, or naturally-occurring mutants thereof. Primers based on a nucleotide sequence of the present invention can be used in PCR reactions to clone LMP homologues. Probes based on the LMP nucleotide sequences can be used to detect transcripts or genomic sequences encoding the same or homologous proteins. In preferred embodiments, the probe further comprises a label group attached thereto, e.g. the label group can be a radioisotope, a fluorescent compound, an enzyme, or an enzyme co-factor. Such probes can be used as a part of a genomic marker test kit for identifying cells that express an LMP, such as by measuring a level of an LMP-encoding nucleic acid in a sample of cells, e.g., detecting LMP mRNA levels or determining whether a genomic LMP gene has been mutated or deleted.

In one embodiment, the nucleic acid molecule of the invention encodes a protein or portion thereof, which includes an amino acid sequence that is sufficiently homologous to an amino acid encoded by a sequence of the present invention, such that the protein or portion thereof maintains the same or a similar function as the wild-type protein. As used herein, the language "sufficiently homologous" refers to proteins, or portions thereof, which have amino acid sequences that include a minimum number of identical or equivalent (e.g., an amino acid residue that has a similar side chain as an amino acid residue in one of the ORFs of a sequence of the present invention) amino acid residues to an amino acid sequence, such that the protein or portion thereof is able to participate in the metabolism of compounds necessary for the production of seed storage compounds in plants, construction of cellular membranes in microorganisms, or plants, or in the transport of molecules across these membranes. Regulatory proteins, such as DNA binding proteins, transcription factors, kinases, phosphatases, or protein members of metabolic pathways, such as the lipid, starch and protein biosynthetic pathways, or membrane transport systems, may play a role in the biosynthesis of seed storage compounds. Examples of such activities are described herein (see putative annotations in Table 15). Examples of LMP-encoding nucleic acid sequences of the present invention.

As altered or increased sugar and/or fatty acid production is a general trait wished to be inherited into a wide variety of plants like maize, wheat, rye, oat, triticale, rice, barley, soybean, peanut, cotton, canola, manihot, pepper, sunflower, sugar beet and tagetes, solanaceous plants like potato, tobacco, eggplant, and tomato, *Vicia* species, pea, alfalfa, bushy plants (coffee, cacao, tea), *Salix* species, trees (oil palm, coconut), and perennial grasses and forage crops, these crop plants are also preferred target plants for genetic engineering as one further embodiment of the present invention.

Portions of proteins encoded by the LMP nucleic acid molecules of the invention are preferably biologically-active portions of one of the LMPs. As used herein, the term "biologically active portion of an LMP" is intended to include a portion, e.g., a domain/motif, of an LMP that participates in the metabolism of compounds necessary for the biosynthesis of seed storage lipids, or the construction of cellular membranes in microorganisms or plants, or in the transport of molecules across these membranes, or has an activity as set forth in Table 15. To determine whether an LMP, or a biologically active portion thereof, can participate in the metabolism of compounds necessary for the production of seed storage compounds and cellular membranes, an assay of enzymatic activity may be performed. Such assay methods are well known to those skilled in the art, and as described in Example 14 of the Exemplification.

Biologically-active portions of an LMP include peptides comprising amino acid sequences derived from the amino acid sequence of an LMP (e.g., an amino acid sequence encoded by a nucleic acid of the present invention or the amino acid sequence of a protein homologous to an LMP, which include fewer amino acids than a full length LMP or the full length protein which is homologous to an LMP) and exhibit at least one activity of an LMP. Typically, biologically active portions (peptides, e.g., peptides which are, for example, 5, 10, 15, 20, 30, 35, 36, 37, 38, 39, 40, 50, 100, or more amino acids in length) comprise a domain or motif with at least one activity of an LMP. Moreover, other biologically active portions, in which other regions of the protein are deleted, can be prepared by recombinant techniques and evaluated for one or more of the activities described herein. Preferably, the biologically active portions of an LMP include one or more selected domains/motifs or portions thereof having biological activity.

Additional nucleic acid fragments encoding biologically-active portions of an LMP can be prepared by isolating a portion of one of the sequences, expressing the encoded portion of the LMP or peptide (e.g., by recombinant expression in vitro), and assessing the activity of the encoded portion of the LMP or peptide.

The invention further encompasses nucleic acid molecules that differ from one of the nucleotide sequences of the present invention (and portions thereof) due to degeneracy of the genetic code, and thus encode the same LMP as that encoded by the nucleotide sequences of the present invention. In a further embodiment, the nucleic acid molecule of the invention encodes a full length protein which is substantially homologous to an amino acid sequence of a polypeptide encoded by an open reading frame specified herein. In one embodiment, the full-length nucleic acid or protein or fragment of the nucleic acid or protein is from *Arabidopsis thaliana, Brassica napus, Glycine max* or *Oryza sativa*.

In addition to the *Arabidopsis thaliana, Brassica napus, Glycine max* and *Oryza sativa* LMP nucleotide sequences of the present invention, it will be appreciated by those skilled in the art that DNA sequence polymorphisms that lead to changes in the amino acid sequences of LMPs may exist within a population (e.g., the *Arabidopsis thaliana, Brassica napus, Glycine max* or *Oryza sativa* population). Such genetic polymorphism in the LMP gene may exist among individuals within a population due to natural variation. As used herein, the terms "gene" and "recombinant gene" refer to nucleic acid molecules comprising an open reading frame encoding an LMP, preferably a *Arabidopsis thaliana, Brassica napus, Glycine max* or *Oryza sativa* LMP. Such natural variations can typically result in 1-40% variance in the nucleotide sequence of the LMP gene. Any and all such nucleotide variations and resulting amino acid polymorphisms in LMP that are the result of natural variation and that do not alter the functional activity of LMPs are intended to be within the scope of the invention.

Nucleic acid molecules corresponding to natural variants and non-*Arabidopsis thaliana, Brassica napus, Glycine max* or *Oryza sativa*, orthologs of the *Arabidopsis thaliana, Brassica napus, Glycine max* or *Oryza sativa* LMP cDNA of the invention can be isolated based on their homology to *Arabidopsis thaliana, Brassica napus, Glycine max* or *Oryza sativa* LMP nucleic acid disclosed herein using the *Arabidopsis thaliana, Brassica napus, Glycine max* or *Oryza sativa* cDNA, or a portion thereof, as a hybridization probe according to standard hybridization techniques under stringent hybridization conditions. As used herein, the term "orthologs" refers to two nucleic acids from different species, but that have evolved from a common ancestral gene by speciation. Normally, orthologs encode proteins having the same or similar functions. Accordingly, in another embodiment, an isolated nucleic acid molecule of the invention is at least 15 nucleotides in length and hybridizes under stringent conditions to the nucleic acid molecule comprising a nucleotide sequence of the present invention. In other embodiments, the nucleic acid is at least 30, 50, 100, 250, or more nucleotides in length. As used herein, the term "hybridizes under stringent conditions" is intended to describe conditions for hybridization and washing, under which nucleotide sequences at least 60% homologous to each other typically remain hybridized to each other. Preferably, the conditions are such that sequences at least about 65%, more preferably at least about 70%, and even more preferably at least about 75% or more homologous to each other typically remain hybridized to each other. Such stringent conditions are known to those skilled in the art and can be found in *Current Protocols in Molecular Biology*, John Wiley & Sons, N.Y., 1989: 6.3.1-6.3.6. A preferred, non-limiting example of stringent hybridization conditions are hybridization in 6× sodium chloride/sodium citrate (SSC) at about 45° C., followed by one or more washes in 0.2×SSC, 0.1% SDS at 50-65° C. Preferably, an isolated nucleic acid molecule of the invention that hybridizes under stringent conditions to a sequence of the present invention corresponds to a naturally occurring nucleic acid molecule. As used herein, a "naturally-occurring" nucleic acid molecule refers to an RNA or DNA molecule having a nucleotide sequence that occurs in nature (e.g., encodes a natural protein). In one embodiment, the nucleic acid encodes a natural *Arabidopsis thaliana, Brassica napus, Glycine max*, or *Oryza sativa* LMP.

In addition to naturally-occurring variants of the LMP sequence that may exist in the population, the skilled artisan will further appreciate that changes can be introduced by mutation into a nucleotide sequence of the present invention, thereby leading to changes in the amino acid sequence of the encoded LMP, without altering the functional ability of the LMP. For example, nucleotide substitutions leading to amino acid substitutions at "non-essential" amino acid residues can be made in a sequence of the present invention. A "non-essential" amino acid residue is a residue that can be altered from the wild-type sequence of one of the LMPs without altering the activity of said LMP, whereas an "essential" amino acid residue is required for LMP activity. Other amino acid residues, however, (e.g., those that are not conserved or only semi-conserved in the domain having LMP activity) may not be essential for activity, and thus are likely to be amenable to alteration without altering LMP activity.

Accordingly, another aspect of the invention pertains to nucleic acid molecules encoding LMPs that contain changes in amino acid residues that are not essential for LMP activity. Such LMPs differ in amino acid sequence from a sequence yet retain at least one of the LMP activities described herein. In one embodiment, the isolated nucleic acid molecule comprises a nucleotide sequence encoding a protein, wherein the protein comprises an amino acid sequence at least about 50% homologous to an amino acid sequence encoded by a nucleic acid of the present invention and is capable of participation in the metabolism of compounds necessary for the production of seed storage compounds in *Arabidopsis thaliana, Brassica napus, Glycine max, Zea mays, Oryza sativa, Triticum aestivum, Hordeum vulgare, Linum usitatissimum, Helianthus anuus*, or *Beta vulgaris* or *Physcomitrella patens*, or cellular membranes, or has one or more activities set forth in Table 15. Preferably, the protein encoded by the nucleic acid molecule is at least about 50-60% homologous to one of the sequences encoded by a specific nucleic acid of the present invention, more preferably at least about 60-70% homologous to one of the sequences encoded by a specific nucleic acid of the present invention, even more preferably at least about 70-80%, 80-90%, 90-95% homologous to one of the sequences encoded by a specific nucleic acid of the present invention, and most preferably at least about 96%, 97%, 98%, or 99% homologous to one of the sequences encoded by a specific nucleic acid of the present invention.

To determine the percent homology of two amino acid sequences (e.g., one of the sequences encoded by a specific nucleic acid of the present invention and a mutant form thereof) or of two nucleic acids, the sequences are aligned for optimal comparison purposes (e.g., gaps can be introduced in the sequence of one protein or nucleic acid for optimal alignment with the other protein or nucleic acid). The amino acid residues or nucleotides at corresponding amino acid positions or nucleotide positions are then compared. When a position in one sequence (e.g., one of the sequences encoded by a specific nucleic acid of the present invention) is occupied by the same amino acid residue or nucleotide as the corresponding position in the other sequence (e.g., a mutant form of the sequence selected from the polypeptide encoded by a specific nucleic acid of the present invention), then the molecules are homologous at that position (i.e., as used herein amino acid or nucleic acid "homology" is equivalent to amino acid or nucleic acid "identity"). The percent homology between the two sequences is a function of the number of identical positions shared by the sequences (i.e., % homology=numbers of identical positions/total numbers of positions×100).

An isolated nucleic acid molecule encoding an LMP homologous to a protein sequence encoded by a nucleic acid of the present invention can be created by introducing one or more nucleotide substitutions, additions or deletions into a nucleotide sequence of the present invention, such that one or more amino acid substitutions, additions or deletions are introduced into the encoded protein. Mutations can be introduced into one of the sequences of the present invention by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine), and aromatic side chains (e.g., tyrosine, phenylalanine, tryptophan, histidine). Thus, a predicted non-essential amino acid residue in an LMP is preferably replaced with another amino acid residue from the same side chain family. Alternatively, in another embodiment, mutations can be introduced randomly along all or part of an LMP coding sequence, such as by saturation mutagenesis, and the resultant mutants can be screened for an LMP activity described herein to identify mutants that retain LMP activity. Following mutagenesis of one of the sequences of the present invention, the encoded protein can be expressed recombinantly and the activity of the protein can be determined using, for example, assays described herein (see Examples 11-13 of the Exemplification).

LMPs are preferably produced by recombinant DNA techniques. For example, a nucleic acid molecule encoding the protein is cloned into an expression vector (as described above), the expression vector is introduced into a host cell (as described herein), and the LMP is expressed in the host cell. The LMP can then be isolated from the cells by an appropriate purification scheme using standard protein purification techniques. Alternative to recombinant expression, an LMP or peptide thereof can be synthesized chemically using standard peptide synthesis techniques. Moreover, native LMP can be isolated from cells, for example using an anti-LMP antibody, which can be produced by standard techniques utilizing an LMP or fragment thereof of this invention.

The invention also provides LMP chimeric or fusion proteins. As used herein, an LMP "chimeric protein" or "fusion protein" comprises an LMP polypeptide operatively linked to a non-LMP polypeptide. An "LMP polypeptide" refers to a polypeptide having an amino acid sequence corresponding to an LMP, whereas a "non-LMP polypeptide" refers to a polypeptide having an amino acid sequence corresponding to a protein which is not substantially homologous to the LMP, e.g., a protein that is different from the LMP, and which is derived from the same or a different organism. Within the fusion protein, the term "operatively linked" is intended to indicate that the LMP polypeptide and the non-LMP polypeptide are fused to each other so that both sequences fulfill the proposed function attributed to the sequence used. The non-LMP polypeptide can be fused to the N-terminus or C-terminus of the LMP polypeptide. For example, in one embodiment, the fusion protein is a GST-LMP (glutathione S-transferase) fusion protein in which the LMP sequences are fused to the C-terminus of the GST sequences. Such fusion proteins can facilitate the purification of recombinant LMPs.

In another embodiment, the fusion protein is an LMP containing a heterologous signal sequence at its N-terminus. In certain host cells (e.g., mammalian host cells), expression and/or secretion of an LMP can be increased through use of a heterologous signal sequence.

Preferably, an LMP chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments, which can subsequently be annealed and reamplified to generate a chimeric gene sequence (see, for example, Current Protocols in Molecular Biology, eds. Ausubel et al., John Wiley & Sons: 1992). Moreover, many expression vectors are commercially available that already encode a fusion moiety (e.g., a GST polypeptide). An LMP-encoding nucleic acid can be cloned into such an expression vector such that the fusion moiety is linked in-frame to the LMP.

In addition to the nucleic acid molecules encoding LMPs described above, another aspect of the invention pertains to isolated nucleic acid molecules that are antisense thereto. An "antisense" nucleic acid comprises a nucleotide sequence that is complementary to a "sense" nucleic acid encoding a protein, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire LMP coding strand, or to only a portion thereof. In one embodiment, an antisense nucleic acid molecule is antisense to a "coding region" of the coding strand of a nucleotide sequence encoding an LMP. The term "coding region" refers to the region of the nucleotide sequence comprising codons that are translated into amino acid residues (e.g., the entire coding region of pk331OS37109650 comprises nucleotides 82-1704). In another embodiment, the antisense nucleic acid molecule is antisense to a "noncoding region" of the coding strand of a nucleotide sequence encoding LMP. The term "noncoding region" refers to 5' and 3' sequences that flank the coding region that are not translated into amino acids (i.e., also referred to as 5' and 3' untranslated regions).

Given the coding strand sequences encoding LMP disclosed herein (e.g., the specific sequences set forth elsewhere herein), antisense nucleic acids of the invention can be designed according to the rules of Watson and Crick base pairing. The antisense nucleic acid molecule can be complementary to the entire coding region of LMP mRNA, but more preferably is an oligonucleotide that is antisense to only a portion of the coding or noncoding region of LMP mRNA. For example, the antisense oligonucleotide can be complementary to the region surrounding the translation start site of LMP mRNA. An antisense oligonucleotide can be, for example, about 5, 10, 15, 20, 25, 30, 35, 40, 45, or 50 nucleotides in length. An antisense or sense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylamino-methyl-2-thiouridine, 5-carboxymethylaminomethyluracil, dihydro-uracil, beta-D-galactosylqueosine, inosine, N-6-isopentenyladenine, 1-methyl-guanine, 1-methylinosine, 2,2-dimethylguanine, 2-methyladenine, 2-methylguanine, 3-methylcytosine, 5-methyl-cytosine, N-6-adenine, 7-methylguanine, 5-methyl-aminomethyluracil, 5-methoxyamino-methyl-2-thiouracil, beta-D-mannosylqueosine, 5'-methoxycarboxymethyl-uracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diamino-purine. Alternatively, the antisense nucleic acid can be produced biologically using an expression vector, into which a nucleic acid has been subcloned in an antisense orientation (i.e., RNA transcribed from the inserted nucleic acid will be of an antisense orientation to a target nucleic acid of interest, described further in the following subsection).

In another variation of the antisense technology, a double-strand. interfering RNA construct can be used to cause a down-regulation of the LMP mRNA level and LMP activity in transgenic plants. This requires transforming the plants with a chimeric construct containing a portion of the LMP sequence in the sense orientation fused to the antisense sequence of the same portion of the LMP sequence. A DNA linker region of variable length can be used to separate the sense and antisense fragments of LMP sequences in the construct.

The antisense nucleic acid molecules of the invention are typically administered to a cell or generated in situ, such that they hybridize with, or bind to, cellular mRNA and/or genomic DNA encoding an LMP to thereby inhibit expression of the protein, e.g., by inhibiting transcription and/or translation. The hybridization can be by conventional nucleotide complementarity to form a stable duplex, or, for example, in the case of an antisense nucleic acid molecule, which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody, which binds to a cell surface receptor or antigen. The antisense nucleic acid molecule can also be delivered to cells using the vectors described herein. To achieve sufficient intracellular concentrations of the antisense molecules, vector constructs, in which the antisense nucleic acid molecule is placed under the control of a strong prokaryotic, viral, or eukaryotic including plant promoters, are preferred.

In yet another embodiment, the antisense nucleic acid molecule of the invention is an anomeric nucleic acid molecule. An anomeric nucleic acid molecule forms specific double-stranded hybrids with complementary RNA, in which, contrary to the usual units, the strands run parallel to each other (Gaultier et al. 1987, Nucleic Acids Res. 15:6625-6641). The antisense nucleic acid molecule can also comprise a 2'-o-methyl-ribonucleotide (Inoue et al. 1987, Nucleic Acids Res. 15:6131-6148) or a chimeric RNA-DNA analogue (Inoue et al. 1987, FEBS Lett. 215:327-330).

In still another embodiment, an antisense nucleic acid of the invention is a ribozyme. Ribozymes are catalytic RNA molecules with ribonuclease activity, which are capable of cleaving a single-stranded nucleic acid, such as an mRNA, to which they have a complementary region. Thus, ribozymes (e.g., hammerhead ribozymes (described in Haselhoff & Gerlach 1988, Nature 334:585-591)) can be used to catalytically cleave LMP mRNA transcripts to thereby inhibit translation of LMP mRNA. A ribozyme having specificity for an LMP-encoding nucleic acid can be designed based upon the nucleotide sequence of an LMP cDNA disclosed herein (i.e., Bn01, below) or on the basis of a heterologous sequence to be isolated according to methods taught in this invention. For example, a derivative of a Tetrahymena L-19 IVS RNA can be constructed, in which the nucleotide sequence of the active site is complementary to the nucleotide sequence to be cleaved in an LMP-encoding mRNA (see, e.g., Cech et al., U.S. Pat. No. 4,987,071 and Cech et al., U.S. Pat. No. 5,116, 742). Alternatively, LMP mRNA can be used to select a catalytic RNA having a specific ribonuclease activity from a pool of RNA molecules (see, e.g., Bartel, D. & Szostak J. W. 1993, Science 261:1411-1418).

Alternatively, LMP gene expression can be inhibited by targeting nucleotide sequences complementary to the regulatory region of an LMP nucleotide sequence (e.g., an LMP promoter and/or enhancers) to form triple helical structures that prevent transcription of an LMP gene in target cells (See generally, Helene C. 1991, Anticancer Drug Des. 6:569-84;

Helene C. et al. 1992, Ann. N.Y. Acad. Sci. 660:27-36; and Maher, L. J. 1992, Bioassays 14:807-15).

Another aspect of the invention pertains to vectors, preferably expression vectors, containing a nucleic acid encoding an LMP (or a portion thereof). As used herein, the term "vector" refers to a nucleic acid molecule capable of transporting another nucleic acid, to which it has been linked. One type of vector is a "plasmid," which refers to a circular, double-stranded DNA loop, into which additional DNA segments can be ligated. Another type of vector is a viral vector, wherein additional DNA segments can be ligated into the viral genome. Certain vectors are capable of autonomous replication in a host cell, into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes, to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner that allows for expression of the nucleotide sequence and both sequences are fused to each other so that each fulfills its proposed function (e.g., in an in vitro transcription/translation system or in a host cell when the vector is introduced into the host cell). The term "regulatory sequence" is intended to include promoters, enhancers, and other expression-control elements (e.g., polyadenylation signals). Such regulatory sequences are described, for example, in Goeddel; Gene Expression Technology: Methods in Enzymology 185, Academic Press, San Diego, Calif. (1990) or see: Gruber and Crosby, in: Methods in Plant Molecular Biology and Biotechnology, CRC Press, Boca Raton, Fla., eds.: Glick & Thompson, Chapter 7, 89-108 including the references therein. Regulatory sequences include those that direct constitutive expression of a nucleotide sequence in many types of host cell and those that direct expression of the nucleotide sequence only in certain host cells or under certain conditions. It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., LMPs, mutant forms of LMPs, fusion proteins, etc.).

The recombinant expression vectors of the invention can be designed for expression of LMPs in prokaryotic or eukaryotic cells. For example, LMP genes can be expressed in bacterial cells, insect cells (using baculovirus expression vectors), yeast and other fungal cells (see Romanos M. A. et al. 1992, Foreign gene expression in yeast: a review, Yeast 8:423-488; van den Hondel, C. A. M. J. J. et al. 1991, Heterologous gene expression in filamentous fungi, in: More Gene Manipulations in Fungi, Bennet & Lasure, eds., p. 396-428: Academic Press: an Diego; and van den Hondel & Punt 1991, Gene transfer systems and vector development for filamentous fungi, in: Applied Molecular Genetics of Fungi, Peberdy et al., eds., p. 1-28, Cambridge University Press: Cambridge), algae (Falciatore et al. 1999, Marine Biotechnology 1:239-251), ciliates of the types: *Holotrichia, Peritrichia, Spirotrichia, Suctoria, Tetrahymena, Paramecium, Colpidium, Glaucoma, Platyophrya, Potomacus, Pseudocohnilembus, Euplotes, Engelmaniella*, and *Stylonychia*, especially of the genus *Stylonychia lemnae* with vectors following a transformation method as described in WO 98/01572 and multicellular plant cells (see Schmidt & Willmitzer 1988, High efficiency *Agrobacterium tumefaciens*-mediated transformation of *Arabidopsis thaliana* leaf and cotyledon plants, Plant Cell Rep.: 583-586); Plant Molecular Biology and Biotechnology, C Press, Boca Raton, Fla., chapter 6/7, S.71-119 (1993); White, Jenes et al., Techniques for Gene Transfer, in: Transgenic Plants, Vol. 1, Engineering and Utilization, eds.: Kung and Wu, Academic Press 1993, 128-43; Potrykus 1991, Annu. Rev. Plant Physiol. Plant Mol. Biol. 42:205-225 (and references cited therein) or mammalian cells. Suitable host cells are discussed further in Goeddel, Gene Expression Technology: Methods in Enzymology 185, Academic Press, San Diego, Calif. 1990). Alternatively, the recombinant expression vector can be transcribed and translated in vitro, for example using T7 promoter regulatory sequences and T7 polymerase.

Expression of proteins in prokaryotes is most often carried out with vectors containing constitutive or inducible promoters directing the expression of either fusion or non-fusion proteins. Fusion vectors add a number of amino acids to a protein encoded therein, usually to the amino terminus of the recombinant protein but also to the C-terminus or fused within suitable regions in the proteins. Such fusion vectors typically serve one or more of the following purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin, and enterokinase.

Typical fusion expression vectors include pGEX (Pharmacia Biotech Inc; Smith & Johnson 1988, Gene 67:31-40), pMAL (New England Biolabs, Beverly, Mass.) and pRIT5 (Pharmacia, Piscataway, N.J.), which fuse glutathione S-transferase (GST), maltose E binding protein, or protein A, respectively, to the target recombinant protein. In one embodiment, the coding sequence of the LMP is cloned into a pGEX expression vector to create a vector encoding a fusion protein comprising, from the N-terminus to the C-terminus, GST-thrombin cleavage site-X protein. The fusion protein can be purified by affinity chromatography using glutathione-agarose resin. Recombinant LMP unfused to GST can be recovered by cleavage of the fusion protein with thrombin.

Examples of suitable inducible non-fusion *E. coli* expression vectors include pTrc (Amann et al. 1988, Gene 69:301-315) and pET 11d (Studier et al. 1990, Gene Expression Technology Methods in Enzymology 185, Academic Press, San Diego, Calif. 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21 (DE3) or HMS174 (DE3) from a resident prophage harboring a T7 gn1 gene under the transcriptional control of the lacUV 5 promoter.

One strategy to maximize recombinant protein expression is to express the protein in a host bacteria with an impaired capacity to proteolytically cleave the recombinant protein (Gottesman S. 1990, Gene Expression Technology: *Methods in Enzymology* 185:119-128, Academic Press, San Diego, Calif.). Another strategy is to alter the nucleic acid sequence of the nucleic acid to be inserted into an expression vector so that the individual codons for each amino acid are those preferentially utilized in the bacterium chosen for expression (Wada et al. 1992, Nucleic Acids Res. 20:2111-2118). Such alteration of nucleic acid sequences of the invention can be carried out by standard DNA synthesis techniques.

In another embodiment, the LMP expression vector is a yeast expression vector. Examples of vectors for expression in yeast *S. cerevisiae* include pYepSec1 (Baldari et al. 1987, Embo J. 6:229-234), pMFa (Kurjan & Herskowitz 1982, Cell 30:933-943), pJRY88 (Schultz et al. 1987, Gene 54:113-123), and pYES2 (Invitrogen Corporation, San Diego, Calif.). Vectors and methods for the construction of vectors appropriate for use in other fungi, such as the filamentous fungi, include those detailed in: van den Hondel & Punt 1991, "Gene transfer systems and vector development for filamentous fungi, in: Applied Molecular Genetics of Fungi, Peberdy et al., eds., p. 1-28, Cambridge University Press: Cambridge.

Alternatively, the LMPs of the invention can be expressed in insect cells using baculovirus expression vectors. Baculovirus vectors available for expression of proteins in cultured insect cells (e.g., Sf 9 cells) include the pAc series (Smith et al. 1983, Mol. Cell. Biol. 3:2156-2165) and the pVL series (Lucklow & Summers 1989, Virology 170:31-39).

In yet another embodiment, a nucleic acid of the invention is expressed in mammalian cells using a mammalian expression vector. Examples of mammalian expression vectors include pCDM8 (Seed 1987, Nature 329:840) and pMT2PC (Kaufman et al. 1987, EMBO J. 6:187-195). When used in mammalian cells, the expression vector's control functions are often provided by viral regulatory elements. For example, commonly used promoters are derived from polyoma, Adenovirus 2, cytomegalovirus, and Simian Virus 40. For other suitable expression systems for both prokaryotic and eukaryotic cells see chapters 16 and 17 of Sambrook, Fritsh and Maniatis, *Molecular Cloning: A Laboratory Manual.* 2nd, ed., Cold Spring Harbor Laboratory, Cold Spring Harbor Laboratory Press, Cold Spring Harbor, N.Y., 1989.

In another embodiment, the LMPs of the invention may be expressed in unicellular plant cells (such as algae, see Falciatore et al. (1999, Marine Biotechnology 1:239-251 and references therein) and plant cells from higher plants (e.g., the spermatophytes, such as crop plants). Examples of plant expression vectors include those detailed in: Becker, Kemper, Schell and Masterson (1992, "New plant binary vectors with selectable markers located proximal to the left border", Plant Mol. Biol. 20:1195-1197) and Bevan (1984, "Binary *Agrobacterium* vectors for plant transformation, Nucleic Acids Res. 12:8711-8721; Vectors for Gene Transfer in Higher Plants; in: Transgenic Plants, Vol. 1, Engineering and Utilization, eds.: Kung und R. Wu, Academic Press, 1993, S. 15-38).

A plant expression cassette preferably contains regulatory sequences capable to drive gene expression in plant cells, and which are operably linked so that each sequence can fulfill its function such as termination of transcription, including polyadenylation signals. Preferred polyadenylation signals are those originating from *Agrobacterium tumefaciens* t-DNA such as the gene 3 known as octopine synthase of the Ti-plasmid pTiACH5 (Gielen et al. 1984, EMBO J. 3:835) or functional equivalents thereof but also all other terminators functionally active in plants are suitable.

As plant gene expression is very often not limited on transcriptional levels a plant expression cassette preferably contains other operably linked sequences like translational enhancers such as the overdrive-sequence containing the 5'-untranslated leader sequence from tobacco mosaic virus enhancing the protein per RNA ratio (Gallie et al. 1987, Nucleic Acids Res. 15:8693-8711).

Plant gene expression has to be operably linked to an appropriate promoter conferring gene expression in a timely, cell or tissue specific manner. Preferred are promoters driving constitutive expression (Benfey et al. 1989, EMBO J. 8:2195-2202) like those derived from plant viruses like the 35S CAMV (Franck et al. 1980, Cell 21:285-294), the 19S CaMV (see also U.S. Pat. No. 5,352,605 and WO 84/02913) or plant promoters like those from Rubisco small subunit described in U.S. Pat. No. 4,962,028. Even more preferred are seed-specific promoters driving expression of LMP proteins during all or selected stages of seed development. Seed-specific plant promoters are known to those of ordinary skill in the art and are identified and characterized using seed-specific mRNA libraries and expression profiling techniques. Seed-specific promoters include the napin-gene promoter from rapeseed (U.S. Pat. No. 5,608,152), the USP-promoter from *Vicia faba* (Baeumlein et al. 1991, Mol. Gen. Genetics 225:459-67), the oleosin-promoter from *Arabidopsis* (WO 98/45461), the phaseolin-promoter from *Phaseolus vulgaris* (U.S. Pat. No. 5,504,200), the Bce-4-promoter from *Brassica* (WO9113980) or the legumin B4 promoter (LeB4; Baeumlein et al. 1992, Plant J. 2:233-239) as well as promoters conferring seed specific expression in monocot plants like maize, barley, wheat, rye, rice etc. Suitable promoters to note are the Ipt2 or Ipt1-gene promoter from barley (WO 95/15389 and WO 95/23230) or those described in WO 99/16890 (promoters from the barley hordein-gene, the rice glutelin gene, the rice oryzin gene, the rice prolamin gene, the wheat gliadin gene, wheat glutelin gene, the maize zein gene, the oat glutelin gene, the *Sorghum kasirin*-gene, and the rye secalin gene).

Plant gene expression can also be facilitated via an inducible promoter (for a review see Gatz 1997, Annu. Rev. Plant Physiol. Plant Mol. Biol. 48:89-108). Chemically inducible promoters are especially suitable if gene expression is desired in a time specific manner. Examples for such promoters are a salicylic acid inducible promoter (WO 95/19443), a tetracycline inducible promoter (Gatz et al. 1992, Plant J. 2:397-404), and an ethanol inducible promoter (WO 93/21334).

Promoters responding to biotic or abiotic stress conditions are also suitable promoters, such as the pathogen inducible PRP1-gene promoter (Ward et al., 1993, Plant. Mol. Biol. 22:361-366), the heat inducible hsp80-promoter from tomato (U.S. Pat. No. 5,187,267), cold inducible alpha-amylase promoter from potato (WO 96/12814), or the wound-inducible pinII-promoter (EP 375091).

Other preferred sequences for use in plant gene expression cassettes are targeting-sequences necessary to direct the gene-product in its appropriate cell compartment (for review see Kermode 1996, Crit. Rev. Plant Sci. 15:285-423 and references cited therein) such as the vacuole, the nucleus, all types of plastids like amyloplasts, chloroplasts, chromoplasts, the extracellular space, mitochondria, the endoplasmic reticulum, oil bodies, peroxisomes and other compartments of plant cells. Also especially suited are promoters that confer plastid-specific gene expression, as plastids are the compartment where precursors and some end products of lipid biosynthesis are synthesized. Suitable promoters such as the viral RNA-polymerase promoter are described in WO 95/16783 and WO 97/06250 and the clpP-promoter from *Arabidopsis* described in WO 99/46394.

The invention further provides a recombinant expression vector comprising a DNA molecule of the invention cloned into the expression vector in an antisense orientation. That is, the DNA molecule is operatively linked to a regulatory sequence in a manner that allows for expression (by transcription of the DNA molecule) of an RNA molecule that is antisense to LMP mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen that direct constitutive, tissue specific or cell type specific expression of antisense RNA. The antisense expression vector can be in the form of a recombinant plasmid, phagemid or attenuated virus, in which antisense nucleic acids are produced under the control of a high efficiency regulatory region, the activity of which can be determined by the cell type into which the vector is introduced. For a discussion of the regulation of gene expression using antisense genes, see Weintraub et al. (1986, Antisense RNA as a molecular tool for genetic analysis, Reviews—Trends in Genetics, Vol. 1) and Mol et al. (1990, FEBS Lett. 268:427-430).

Another aspect of the invention pertains to host cells, into which a recombinant expression vector of the invention has been introduced. The terms "host cell" and "recombinant host cell" are used interchangeably herein. It is to be understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, an LMP can be expressed in bacterial cells, insect cells, fungal cells, mammalian cells (such as Chinese hamster ovary cells (CHO) or COS cells), algae, ciliates, or plant cells. Other suitable host cells are known to those skilled in the art.

Vector DNA can be introduced into prokaryotic or eukaryotic cells via conventional transformation or transfection techniques. As used herein, the terms "transformation" and "transfection," "conjugation" and "transduction" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, natural competence, chemical-mediated transfer, or electroporation. Suitable methods for transforming or transfecting host cells including plant cells can be found in Sambrook et al. (1989, Molecular Cloning: A Laboratory Manual. 2nd, ed., Cold Spring Harbor Laboratory, Cold Spring Harbor Laboratory Press, Cold Spring Harbor, N.Y.) and other laboratory manuals such as Methods in Molecular Biology 1995, Vol. 44, *Agrobacterium* protocols, ed: Gartland and Davey, Humana Press, Totowa, N.J.

For stable transfection of mammalian and plant cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those that confer resistance to drugs, such as G418, hygromycin, kanamycin, and methotrexate, or in plants that confer resistance towards an herbicide, such as glyphosate or glufosinate. A nucleic acid encoding a selectable marker can be introduced into a host cell on the same vector as that encoding an LMP or can be introduced on a separate vector. Cells stably transfected with the introduced nucleic acid can be identified by, for example, drug selection (e.g., cells that have incorporated the selectable marker gene will survive, while the other cells die).

To create a homologous recombinant microorganism, a vector is prepared that contains at least a portion of an LMP gene, into which a deletion, addition, or substitution has been introduced to thereby alter, e.g., functionally disrupt, the LMP gene. Preferably, this LMP gene is an *Arabidopsis thaliana, Brassica napus* or *Glycine max* LMP gene, but it can be a homologue from a related plant or even from a mammalian, yeast, or insect source. In a preferred embodiment, the vector is designed such that, upon homologous recombination, the endogenous LMP gene is functionally disrupted (i.e., no longer encodes a functional protein; also referred to as a knock-out vector). Alternatively, the vector can be designed such that, upon homologous recombination, the endogenous LMP gene is mutated or otherwise altered but still encodes functional protein (e.g., the upstream regulatory region can be altered to thereby alter the expression of the endogenous LMP). To create a point mutation via homologous recombination, DNA-RNA hybrids can be used in a technique known as chimeraplasty (Cole-Strauss et al. 1999, Nucleic Acids Res. 27:1323-1330 and Kmiec 1999, American Scientist 87:240-247). Homologous recombination procedures in *Arabidopsis thaliana* or other crops are also well known in the art and are contemplated for use herein.

In a homologous recombination vector, the altered portion of the LMP gene is flanked at its 5' and 3' ends by additional nucleic acid of the LMP gene to allow for homologous recombination to occur between the exogenous LMP gene carried by the vector and an endogenous LMP gene in a microorganism or plant. The additional flanking LMP nucleic acid is of sufficient length for successful homologous recombination with the endogenous gene. Typically, several hundreds of base pairs up to kilobases of flanking DNA (both at the 5' and 3' ends) are included in the vector (see e.g., Thomas & Capecchi 1987, Cell 51:503, for a description of homologous recombination vectors). The vector is introduced into a microorganism or plant cell (e.g., via polyethyleneglycol mediated DNA). Cells in which the introduced LMP gene has homologously recombined with the endogenous LMP gene are selected using art-known techniques.

In another embodiment, recombinant microorganisms can be produced that contain selected systems that allow for regulated expression of the introduced gene. For example, inclusion of an LMP gene on a vector placing it under control of the lac operon permits expression of the LMP gene only in the presence of IPTG. Such regulatory systems are well known in the art.

A host cell of the invention, such as a prokaryotic or eukaryotic host cell in culture can be used to produce (i.e., express) an LMP. Accordingly, the invention further provides methods for producing LMPs using the host cells of the invention. In one embodiment, the method comprises culturing a host cell of the invention (into which a recombinant expression vector encoding an LMP has been introduced, or which contains a wild-type or altered LMP gene in its genome) in a suitable medium until LMP is produced. In another embodiment, the method further comprises isolating LMPs from the medium or the host cell.

Another aspect of the invention pertains to isolated LMPs, and biologically active portions thereof. An "isolated" or "purified" protein or biologically active portion thereof is substantially free of cellular material when produced by recombinant DNA techniques, or chemical precursors or other chemicals when chemically synthesized. The language "substantially free of cellular material" includes preparations of LMP, in which the protein is separated from cellular components of the cells, in which it is naturally or recombinantly produced. In one embodiment, the language "substantially free of cellular material" includes preparations of LMP having less than about 30% (by dry weight) of non-LMP (also referred to herein as a "contaminating protein"), more preferably less than about 20% of non-LMP, still more preferably less than about 10% of non-LMP, and most preferably less than about 5% non-LMP. When the LMP or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations of LMP in which the protein is separated from chemical precursors or other chemicals that are involved in the synthesis of the protein. In one embodiment, the language "substantially free of chemical precursors or other chemicals" includes preparations of LMP having less than about 30% (by dry weight) of chemical precursors or non-LMP chemicals, more preferably less than about 20% chemical precursors or non-LMP chemicals, still more preferably less than about 10% chemical precursors or non-LMP chemicals, and most preferably less than about 5% chemical precursors or non-LMP chemicals. In preferred embodiments, isolated proteins or biologically active portions thereof lack contaminating proteins from the same organism from which the LMP is derived. Typically, such proteins are produced by recombinant expression of, for example, an *Arabidopsis thaliana* LMP in other plants than *Arabidopsis thaliana* or the moss *Physcomitrella patens* or microorganisms, algae or fungi.

An isolated LMP or a portion thereof of the invention can participate in the metabolism of compounds necessary for the production of seed storage compounds in *Arabidopsis thaliana, Brassica napus, Glycine max, Zea mays, Oryza sativa, Linum usitatissimum, Hordeum vulgare, Triticum aestivum, Helianthus anuus*, or *Beta vulgaris* or *Physcomitrella patens* or of cellular membranes, or has one or more of the activities set forth in Table 15. In preferred embodiments, the protein or portion thereof comprises an amino acid sequence which is sufficiently homologous to an amino acid sequence encoded by a nucleic acid of the present invention, such that the protein or portion thereof maintains the ability to participate in the metabolism of compounds necessary for the construction of cellular membranes in *Arabidopsis thaliana, Brassica napus, Glycine max, Zea mays, Oryza sativa, Linum usitatissimum, Hordeum vulgare, Triticum aestivum, Helianthus anuus, Beta vulgaris* or *Physcomitrella patens*, or in the transport of molecules across these membranes. The portion of the protein is preferably a biologically active portion as described herein. In another preferred embodiment, an LMP of the invention has an amino acid sequence encoded by a nucleic acid of the present invention. In yet another preferred embodiment, the LMP has an amino acid sequence, which is encoded by a nucleotide sequence, which hybridizes, e.g., hybridizes under stringent conditions, to a nucleotide sequence of the present invention. In still another preferred embodiment, the LMP has an amino acid sequence, which is encoded by a nucleotide sequence that is at least about 50-60%, preferably at least about 60-70%, more preferably at least about 70-80%, 80-90%, 90-95%, and even more preferably at least about 96%, 97%, 98%, 99% or more homologous to one of the amino acid sequences encoded by a nucleic acid of the present invention. The preferred LMPs of the present invention also preferably possess at least one of the LMP activities described herein. For example, a preferred LMP of the present invention includes an amino acid sequence encoded by a nucleotide sequence which hybridizes, e.g., hybridizes under stringent conditions, to a nucleotide sequence of the present invention and which can participate in the metabolism of compounds necessary for the construction of cellular membranes in *Arabidopsis thaliana, Brassica napus, Glycine max, Zea mays, Oryza sativa, Linum usitatissimum, Hordeum vulgare, Triticum aestivum, Helianthus anuus, Beta vulgaris*, or *Physcomitrella patens*, or in the transport of molecules across these membranes, or which has one or more of the activities set forth in Table 15.

In other embodiments, the LMP is substantially homologous to an amino acid sequence encoded by a nucleic acid of the present invention and retains the functional activity of the protein of one of the sequences encoded by a nucleic acid of the present invention yet differs in amino acid sequence due to natural variation or mutagenesis, as described in detail above. Accordingly, in another embodiment, the LMP is a protein which comprises an amino acid sequence which is at least about 50-60%, preferably at least about 60-70%, and more preferably at least about 70-80, 80-90, 90-95%, and most preferably at least about 96%, 97%, 98%, 99%, or more homologous to an entire amino acid sequence and which has at least one of the LMP activities described herein. In another embodiment, the invention pertains to a full *Arabidopsis thaliana, Brassica napus, Glycine max* or *Oryza sativa* protein which is substantially homologous to an entire amino acid sequence encoded by a nucleic acid of the present invention.

Dominant negative mutations or trans-dominant suppression can be used to reduce the activity of an LMP in transgenics seeds in order to change the levels of seed storage compounds. To achieve this a mutation that abolishes the activity of the LMP is created and the inactive non-functional LMP gene is overexpressed in the transgenic plant. The inactive trans-dominant LMP protein competes with the active endogenous LMP protein for substrate or interactions with other proteins and dilutes out the activity of the active LMP. In this way the biological activity of the LMP is reduced without actually modifying the expression of the endogenous LMP gene. This strategy was used by Pontier et al to modulate the activity of plant transcription factors (Pontier D, Miao Z H, Lam E, Plant J 2001 Sep. 27(6): 529-38, Trans-dominant suppression of plant TGA factors reveals their negative and positive roles in plant defense responses).

Homologues of the LMP can be generated by mutagenesis, e.g., discrete point mutation or truncation of the LMP. As used herein, the term "homologue" refers to a variant form of the LMP that acts as an agonist or antagonist of the activity of the LMP. An agonist of the LMP can retain substantially the same, or a subset, of the biological activities of the LMP. An antagonist of the LMP can inhibit one or more of the activities of the naturally occurring form of the LMP, by, for example, competitively binding to a downstream or upstream member of the cell membrane component metabolic cascade which includes the LMP, or by binding to an LMP which mediates transport of compounds across such membranes, thereby preventing translocation from taking place.

In an alternative embodiment, homologues of the LMP can be identified by screening combinatorial libraries of mutants, e.g., truncation mutants, of the LMP for LMP agonist or antagonist activity. In one embodiment, a variegated library of LMP variants is generated by combinatorial mutagenesis at the nucleic acid level and is encoded by a variegated gene library. A variegated library of LMP variants can be produced by, for example, enzymatically ligating a mixture of synthetic oligonucleotides into gene sequences such that a degenerate set of potential LMP sequences is expressible as individual polypeptides, or alternatively, as a set of larger fusion proteins (e.g., for phage display) containing the set of LMP sequences therein. There are a variety of methods that can be used to produce libraries of potential LMP homologues from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential LMP sequences. Methods for synthesizing degenerate oligonucleotides are known in the art (see, e.g., Narang 1983, Tetrahedron 39:3; Itakura et al. 1984, Annu. Rev. Biochem. 53:323; Itakura et al. 1984, Science 198:1056; Ike et al. 1983, Nucleic Acids Res. 11:477).

In addition, libraries of fragments of the LMP coding sequences can be used to generate a variegated population of LMP fragments for screening and subsequent selection of homologues of an LMP. In one embodiment, a library of coding sequence fragments can be generated by treating a double-stranded PCR fragment of an LMP coding sequence with a nuclease under conditions, wherein nicking occurs only about once per molecule, denaturing the double stranded DNA, renaturing the DNA to form double stranded DNA, which can include sense/antisense pairs from different nicked products, removing single stranded portions from reformed duplexes by treatment with S1 nuclease, and ligating the resulting fragment library into an expression vector. By this method, an expression library can be derived, which encodes N-terminal, C-terminal and internal fragments of various sizes of the LMP.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of LMP homologues. The most widely used techniques, which are amenable to high through-put analysis, for screening large gene libraries typically include cloning the gene library into replicable expression vectors, transforming appropriate cells with the resulting library of vectors, and expressing the combinatorial genes under conditions, in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify LMP homologues (Arkin & Yourvan 1992, Proc. Natl. Acad. Sci. USA 89:7811-7815; Delgrave et al. 1993, Protein Engineering 6:327-331).

In another embodiment, cell based assays can be exploited to analyze a variegated LMP library, using methods well known in the art.

The nucleic acid molecules, proteins, protein homologues, fusion proteins, primers, vectors, and host cells described herein can be used in one or more of the following methods: identification of *Arabidopsis thaliana, Brassica napus, Glycine max, Zea mays, Oryza sativa, Linum usitatissimum, Hordeum vulgare, Triticum aestivum, Helianthus anuus, Beta vulgaris* or *Physcomitrella patens* and related organisms; mapping of genomes of organisms related to *Arabidopsis thaliana, Brassica napus, Glycine max, Zea mays, Oryza sativa, Linum usitatissimum, Hordeum vulgare, Triticum aestivum, Helianthus anuus, Beta vulgaris* or *Physcomitrella patens*; identification and localization of *Arabidopsis thaliana, Brassica napus, Glycine max, Zea mays, Oryza sativa, Linum usitatissimum, Hordeum vulgare, Triticum aestivum, Helianthus anuus, Beta vulgaris* or *Physcomitrella patens* sequences of interest; evolutionary studies; determination of LMP regions required for function; modulation of an LMP activity; modulation of the metabolism of one or more cell functions; modulation of the transmembrane transport of one or more compounds; and modulation of seed storage compound accumulation.

The plant *Arabidopsis thaliana* represents one member of higher (or seed) plants. It is related to other plants such as *Brassica napus, Glycine max, Zea mays, Linum usitatissimum, Hordeum vulgare, Oryza sativa, Helianthus anuus, Beta vulgaris* or *Triticum aestivum* which require light to drive photosynthesis and growth. Plants like *Arabidopsis thaliana, Brassica napus, Glycine max, Zea mays, Linum usitatissimum, Hordeum vulgare, Oryza sativa, Helianthus anuus, Beta vulgaris, Triticum aestivum* or the moss *Physcomitrella patens* share a high degree of homology on the DNA sequence and polypeptide level, allowing the use of heterologous screening of DNA molecules with probes evolving from other plants or organisms, thus enabling the derivation of a consensus sequence suitable for heterologous screening or functional annotation and prediction of gene functions in third species. The ability to identify such functions can therefore have significant relevance, e.g., prediction of substrate specificity of enzymes. Further, these nucleic acid molecules may serve as reference points for the mapping of *Arabidopsis* genomes, or of genomes of related organisms.

The LMP nucleic acid molecules of the invention have a variety of uses. First, the nucleic acid and protein molecules of the invention may serve as markers for specific regions of the genome. This has utility not only in the mapping of the genome, but also for functional studies of *Arabidopsis thaliana, Brassica napus, Glycine max, Zea mays, Oryza sativa, Linum usitatissimum, Hordeum vulgare, Triticum aestivum, Helianthus anuus, Beta vulgaris* or *Physcomitrella patens* proteins. For example, to identify the region of the genome to which a particular *Arabidopsis thaliana, Brassica napus, Glycine max, Zea mays, Linum usitatissimum, Hordeum vulgare, Oryza sativa, Triticum aestivum, Helianthus anuus, Beta vulgaris* or *Physcomitrella patens* DNA-binding protein binds, the *Arabidopsis thaliana, Brassica napus, Glycine max, Zea mays, Linum usitatissimum, Hordeum vulgare, Oryza sativa, Triticum aestivum, Helianthus anuus, Beta vulgaris* or *Physcomitrella patens* genome could be digested, and the fragments incubated with the DNA-binding protein. Those that bind the protein may be additionally probed with the nucleic acid molecules of the invention, preferably with readily detectable labels; binding of such a nucleic acid molecule to the genome fragment enables the localization of the fragment to the genome map of *Arabidopsis thaliana, Brassica napus, Glycine max, Zea mays, Linum usitatissimum, Hordeum vulgare, Oryza sativa, Triticum aestivum, Helianthus anuus, Beta vulgaris* or *Physcomitrella patens*, and, when performed multiple times with different enzymes, facilitates a rapid determination of the nucleic acid sequence to which the protein binds. Further, the nucleic acid molecules of the invention may be sufficiently homologous to the sequences of related species such that these nucleic acid molecules may serve as markers for the construction of a genomic map in related plants.

The LMP nucleic acid molecules of the invention are also useful for evolutionary and protein structural studies. The metabolic and transport processes, in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment, of which regions of the sequence are conserved and which are not, which may aid in determining those regions of the protein, which are essential for the functioning of the enzyme. This type of determination is of value for protein engineering studies and may give an indication of what the protein can tolerate in terms of mutagenesis without losing function.

Manipulation of the LMP nucleic acid molecules of the invention may result in the production of LMPs having functional differences from the wild-type LMPs. These proteins may be improved in efficiency or activity, may be present in greater numbers in the cell than is usual, or may be decreased in efficiency or activity.

There are a number of mechanisms by which the alteration of an LMP of the invention may directly affect the accumulation and/or composition of seed storage compounds. In the case of plants expressing LMPs, increased transport can lead to altered accumulation of compounds and/or solute partitioning within the plant tissue and organs which ultimately could be used to affect the accumulation of one or more seed storage compounds during seed development. An example is provided by Mitsukawa et al. (1997, Proc. Natl. Acad. Sci. USA 94:7098-7102), where overexpression of an *Arabidopsis* high-affinity phosphate transporter gene in tobacco cultured cells enhanced cell growth under phosphate-limited conditions. Phosphate availability also affects significantly the production of sugars and metabolic intermediates (Hurry et al. 2000, Plant J. 24:383-396) and the lipid composition in leaves and roots (Härtel et al. 2000, Proc. Natl. Acad. Sci. USA 97:10649-10654). Likewise, the activity of the plant ACCase has been demonstrated to be regulated by phosphorylation (Savage & Ohlrogge 1999, Plant J. 18:521-527) and alterations in the activity of the kinases and phosphatases (LMPs) that act on the ACCase could lead to increased or decreased levels of seed lipid accumulation. Moreover, the presence of lipid kinase activities in chloroplast envelope membranes suggests that signal transduction pathways and/or membrane protein regulation occur in envelopes (see, e.g., Müller et al. 2000, J. Biol. Chem. 275:19475-19481 and literature cited therein). The ABI1 and ABI2 genes encode two protein serine/threonine phosphatases 2C, which are regulators in abscisic acid signaling pathway, and thereby in early and late seed development (e.g. Merlot et al. 2001, Plant J. 25:295-303). For more examples see also the section "Background of the Invention."

The present invention also provides antibodies that specifically bind to an LMP-polypeptide, or a portion thereof, as encoded by a nucleic acid disclosed herein or as described herein.

Antibodies can be made by many well-known methods (see, e.g. Harlow and Lane, "Antibodies: A Laboratory Manual," Cold Spring Harbor Laboratory, Cold Spring Harbor, N.Y., 1988). Briefly, purified antigen can be injected into an animal in an amount and in intervals sufficient to elicit an immune response. Antibodies can either be purified directly, or spleen cells can be obtained from the animal. The cells can then fused with an immortal cell line and screened for antibody secretion. The antibodies can be used to screen nucleic acid clone libraries for cells secreting the antigen. Those positive clones can then be sequenced (see, for example, Kelly et al. 1992, Bio/Technology 10:163-167; Bebbington et al. 1992, Bio/Technology 10:169-175).

The phrase "selectively binds" with the polypeptide refers to a binding reaction, which is determinative of the presence of the protein in a heterogeneous population of proteins and other biologics. Thus, under designated immunoassay conditions, the specified antibodies bound to a particular protein do not bind in a significant amount to other proteins present in the sample. Selective binding to an antibody under such conditions may require an antibody that is selected for its specificity for a particular protein. A variety of immunoassay formats may be used to select antibodies that selectively bind with a particular protein. For example, solid-phase ELISA immuno-assays are routinely used to select antibodies selectively immunoreactive with a protein. See Harlow and Lane "Antibodies, A Laboratory Manual," Cold Spring Harbor Publications, New York (1988), for a description of immunoassay formats and conditions that could be used to determine selective binding.

In some instances, it is desirable to prepare monoclonal antibodies from various hosts. A description of techniques for preparing such monoclonal antibodies may be found in Stites et al., editors, "Basic and Clinical Immunology," (Lange Medical Publications, Los Altos, Calif., Fourth Edition) and references cited therein, and in Harlow and Lane ("Antibodies, A Laboratory Manual," Cold Spring Harbor Publications, New York, 1988).

Throughout this application, various publications are referenced. The disclosures of all of these publications and those references cited within those publications in their entireties are hereby incorporated by reference into this application in order to more fully describe the state of the art, to which this invention pertains.

FIGURES

FIGS. 1A-C: Nucleic acid sequence (SEQ ID NO: 1), open reading frame of the nucleic acid sequence (positions 1-2568 of SEQ ID NO: 1), and amino acid sequence (SEQ ID NO: 2) of pk321AT01.

FIGS. 2A-C: Nucleic acid sequence (SEQ ID NO: 63), open reading frame of the nucleic acid sequence (positions 1-1218 of SEQ ID NO: 63), and amino acid sequence (SEQ ID NO: 64) of pk322AT01.

FIGS. 3A-C: Nucleic acid sequence (SEQ ID NO: 87), open reading frame of the nucleic acid sequence (positions 1-927 of SEQ ID NO: 87), and amino acid sequence (SEQ ID NO: 88) of pk323AT01.

FIGS. 4A-C: Nucleic acid sequence (SEQ ID NO: 158), open reading frame of the nucleic acid sequence (positions 1-1209 of SEQ ID NO: 158), and amino acid sequence (SEQ ID NO: 159) of pk324AT01.

FIGS. 5A-C: Nucleic acid sequence (SEQ ID NO: 238), open reading frame of the nucleic acid sequence (positions 1-1254 of SEQ ID NO: 238), and amino acid sequence (SEQ ID NO: 239) of pk325AT01.

FIGS. 6A-C: Nucleic acid sequence (SEQ ID NO: 273), open reading frame of the nucleic acid sequence (positions 1-1203 of SEQ ID NO: 273), and amino acid sequence (SEQ ID NO: 274) of pk326AT01.

FIGS. 7A-C: Nucleic acid sequence (SEQ ID NO: 321), open reading frame of the nucleic acid sequence (positions 1-798 of SEQ ID NO: 321), and amino acid sequence (SEQ ID NO: 322) of pk327AT01.

FIGS. 8A-C: Nucleic acid sequence (SEQ ID NO: 552), open reading frame of the nucleic acid sequence (positions 1-870 of SEQ ID NO: 552), and amino acid sequence (SEQ ID NO: 553) of pk328AT01.

FIGS. 9A-C: Nucleic acid sequence (SEQ ID NO: 591), open reading frame of the nucleic acid sequence (positions 1-753 of SEQ ID NO: 591), and amino acid sequence (SEQ ID NO: 592) of pk329AT01.

FIGS. 10A-C: Nucleic acid sequence (SEQ ID NO: 625), open reading frame of the nucleic acid sequence (positions 1-1608 of SEQ ID NO: 625), and amino acid sequence (SEQ ID NO: 626) of pk331AT01.

FIGS. 11A-C: Nucleic acid sequence (SEQ ID NO: 637), open reading frame of the nucleic acid sequence (positions 44-1633 of SEQ ID NO: 637), and amino acid sequence (SEQ ID NO: 638) of pk331GM59746258.

FIGS. 12A-C: Nucleic acid sequence (SEQ ID NO: 629), open reading frame of the nucleic acid sequence (positions 1-1557 of SEQ ID NO: 629), and amino acid sequence (SEQ ID NO: 630) of pk331OS37109650.

FIGS. 13A-C: Nucleic acid sequence (SEQ ID NO: 657), open reading frame of the nucleic acid sequence (positions 31-1509 of SEQ ID NO: 657), and amino acid sequence (SEQ ID NO: 658) of pk320AT01.

FIGS. 14A-C: Nucleic acid sequence (SEQ ID NO: 681), open reading frame of the nucleic acid sequence (positions 272-1765 of SEQ ID NO: 681), and amino acid sequence (SEQ ID NO: 682) of pk320BN51431102.

FIGS. 15A-C: Nucleic acid sequence (SEQ ID NO: 659), open reading frame of the nucleic acid sequence (positions 243-1742 of SEQ ID NO: 659), and amino acid sequence (SEQ ID NO: 660) of pk320GM59682267.

FIGS. 16A-C: Nucleic acid sequence (SEQ ID NO: 778), open reading frame of the nucleic acid sequence (positions 100-1812 of SEQ ID NO: 778), and amino acid sequence (SEQ ID NO: 779) of pk316BN44215842.

It will be apparent to those skilled in the art that various modifications and variations can be made in the present invention without departing from the scope or spirit of the invention. Other embodiments of the invention will be apparent to those skilled in the art from consideration of the specification and practice of the invention disclosed herein. It is intended that the specification and Examples be considered as exemplary only, with a true scope and spirit of the invention being indicated by the claims included herein.

EXAMPLES

Example 1

General Processes a) General Cloning Processes

Cloning processes such as, for example, restriction cleavages, agarose gel electrophoresis, purification of DNA fragments, transfer of nucleic acids to nitrocellulose and nylon membranes, linkage of DNA fragments, transformation of *Escherichia coli* and yeast cells, growth of bacteria and sequence analysis of recombinant DNA were carried out as described in Sambrook et al. (1989, Cold Spring Harbor Laboratory Press: ISBN 0-87969-309-6) or Kaiser, Michaelis and Mitchell (1994, "Methods in Yeast Genetics," Cold Spring Harbor Laboratory Press: ISBN 0-87969-451-3).

b) Chemicals

The chemicals used were obtained, if not mentioned otherwise in the text, in p.a. quality from the companies Fluka (Neu-Ulm), Merck (Darmstadt), Roth (Karlsruhe), Serva (Heidelberg) and Sigma (Deisenhofen). Solutions were prepared using purified, pyrogen-free water, designated as $H_2O$ in the following text, from a Milli-Q water system water purification plant (Millipore, Eschborn). Restriction endonucleases, DNA-modifying enzymes, and molecular biology kits were obtained from the companies AGS (Heidelberg), Amersham (Braunschweig), Biometra (Göttingen), Boehringer (Mannheim), Genomed (Bad Oeynnhausen), New England Biolabs (Schwalbach/Taunus), Novagen (Madison, Wis., USA), Perkin-Elmer (Weiterstadt), Pharmacia (Freiburg), Qiagen (Hilden), and Stratagene (Amsterdam, Netherlands). They were used, if not mentioned otherwise, according to the manufacturer's instructions.

c) Plant Material and Growth:

*Arabidopsis* Plants

*Arabidopsis thaliana* cv Columbia were grown on plates with half-strength MS medium (Murashige & Skoog, 1962, *Physiol. Plant.* 15:473-497), pH 6.2, 2% sucrose and 0.8% agar. Seeds were sterilized for 20 minutes in 20% bleach 0.5% triton X100 and rinsed 6 times with excess sterile water. Wild type *Arabidopsis* seeds were preincubated for three days in the dark at 4° C. before placing them into an incubator (AR-75, Percival Scientific, Boone, Iowa) at a photon flux density of 60-80 µmol $m^{-2}$ $s^{-1}$ and a light period of 16 hours (22° C.), and a dark period of 8 hours (18° C.). Plants were either grown as described above or on soil under standard conditions as described in Focks & Benning (1998, Plant Physiol. 118:91-101).

*Brassica napus*

*Brassica napus* varieties AC Excel and Cresor were used for this study to create cDNA libraries. Seed, seed pod, flower, leaf, stem and root tissues were collected from plants that were in some cases dark-, salt-, heat- and drought-treated. However, this study focused on the use of seed and seed-pod tissues for cDNA libraries. Plants were tagged to harvest seeds collected 60-75 days after planting from two time points: 1-15 days and 15-25 days after anthesis. Plants have been grown in Metromix (Scotts, Marysville, Ohio) at 71° F. under a 14 hr photoperiod. Six seed and seed pod tissues of interest in this study were collected to create the following cDNA libraries: Immature seeds, mature seeds, immature seed pods, mature seed pods, night-harvested seed pods and Cresor variety (high erucic acid) seeds. Tissue samples were collected within specified time points for each developing tissue and multiple samples within a time frame pooled together for eventual extraction of total RNA. Samples from immature seeds were taken between 1-25 days after anthesis (daa), mature seeds between 25-50 daa, immature seed pods between 1-15 daa, mature seed pods between 15-50 daa, night-harvested seed pods between 1-50 daa and Cresor seeds 5-25 daa.

*Glycine max*

*Glycine max* cv. Resnick was used for this study to create cDNA libraries. Seed, seed pod, flower, leaf, stem and root tissues were collected from plants that were in some cases dark-, salt-, heat- and drought-treated. In some cases plants have been nematode infected as well. However, this study focused on the use of seed and seed-pod tissues for cDNA libraries. Plants were tagged to harvest seeds at the set days after anthesis: 5-15, 15-25, 25-35, & 33-50.

*Oryza sativa*

*Oryza sativa* ssp. Japonica cv. Nippon-barre was used for this study to create cDNA libraries. Seed, seed pod, flower, leaf, stem and root tissues were collected from plants that were in some cases dark-, salt-, heat- and drought-treated. This study focused on the use of seed embryo tissues for cDNA libraries. Embryo and endosperm were collected separately in case endosperm tissue might interfere with RNA extraction. Plants have been grown in the greenhouse on Wisconsin soil (has high organic matter) at 85° F. under a 14-h photoperiod. Rice embryos were dissected out of the developing seeds.

Example 2

Total DNA Isolation from Plants

The details for the isolation of total DNA relate to the working up of one gram fresh weight of plant material.

CTAB buffer: 2% (w/v) N-cethyl-N,N,N-trimethylammonium bromide (CTAB); 100 mM Tris HCl pH 8.0; 1.4 M NaCl; 20 mM EDTA. N-Laurylsarcosine buffer: 10% (w/v) N-laurylsarcosine; 100 mM Tris HCl pH 8.0; 20 mM EDTA.

The plant material was triturated under liquid nitrogen in a mortar to give a fine powder and transferred to 2 ml Eppendorf vessels. The frozen plant material was then covered with a layer of 1 ml of decomposition buffer (1 ml CTAB buffer, 100 µl of N-laurylsarcosine buffer, 20 µl of β-mercaptoethanol and 10 µl of proteinase K solution, 10 mg/ml) and incubated at 60° C. for one hour with continuous shaking. The homogenate obtained was distributed into two Eppendorf vessels (2 ml) and extracted twice by shaking with the same volume of chloroform/isoamyl alcohol (24:1). For phase separation, centrifugation was carried out at 8000 g and RT for 15 min in each case. The DNA was then precipitated at −70° C. for 30 min using ice-cold isopropanol. The precipitated DNA was sedimented at 4° C. and 10,000 g for 30 min and resuspended in 180 µl of TE buffer (Sambrook et al. 1989, Cold Spring Harbor Laboratory Press: ISBN 0-87969-309-6). For further purification, the DNA was treated with NaCl (1.2 M final concentration) and precipitated again at −70° C. for 30 min using twice the volume of absolute ethanol. After a washing step with 70% ethanol, the DNA was dried and subsequently taken up in 50 µl of H$_2$O+RNAse (50 mg/ml final concentration). The DNA was dissolved overnight at 4° C. and the RNAse digestion was subsequently carried out at 37° C. for 1 h. Storage of the DNA took place at 4° C.

Example 3

Isolation of Total RNA and poly-(A)+ RNA from Plants—*Arabidopsis thaliana*

For the investigation of transcripts, both total RNA and poly-(A)+ RNA were isolated. RNA is isolated from siliques of *Arabidopsis* plants according to the following procedure:

RNA Preparation from *Arabidopsis* Seeds—"Hot" Extraction:

1. Buffers, enzymes and solution
   2M KCl
   Proteinase K
   Phenol (for RNA)
   Chloroform:Isoamylalcohol
   (Phenol:choloroform 1:1; pH adjusted for RNA)
   4 M LiCl, DEPC-treated
   DEPC-treated water
   3M NaOAc, pH 5, DEPC-treated
   Isopropanol
   70% ethanol (made up with DEPC-treated water)
   Resuspension buffer: 0.5% SDS, 10 mM Tris pH 7.5, 1 mM EDTA made up with DEPC-treated water as this solution can not be DEPC-treated
   Extraction Buffer:
   0.2M Na Borate
   30 mM EDTA
   30 mM EGTA
   1% SDS (250 µl of 10% SDS-solution for 2.5 ml buffer)
   1% Deoxycholate (25 mg for 2.5 ml buffer)
   2% PVPP (insoluble −50 mg for 2.5 ml buffer)
   2% PVP 40K (50 mg for 2.5 ml buffer)
   10 mM DTT
   100 mM β-Mercaptoethanol (fresh, handle under fume hood—use 35 µl of 14.3M solution for 5 ml buffer)

2. Extraction. Heat extraction buffer up to 80° C. Grind tissue in liquid nitrogen-cooled mortar, transfer tissue powder to 1.5 ml tube. Tissue should kept frozen until buffer is added so transfer the sample with pre-cooled spatula and keep the tube in liquid nitrogen all time. Add 350 µl preheated extraction buffer (here for 100 mg tissue, buffer volume can be as much as 500 µl for bigger samples) to tube, vortex and heat tube to 80° C. for ~1 min. Keep then on ice. Vortex sample, grind additionally with electric mortar.

3. Digestion. Add Proteinase K (0.15 mg/100 mg tissue), vortex and keep at 37° C. for one hour.

First Purification. Add 27 µl 2M KCl. Chill on ice for 10 min. Centrifuge at 12.000 rpm for 10 minutes at room temperature. Transfer supernatant to fresh, RNAase-free tube and do one phenol extraction, followed by a chloroform:isoamylalcohol extraction. Add 1 vol. isopropanol to supernatant and chill on ice for 10 min. Pellet RNA by centrifugation (7000 rpm for 10 min at RT). Resolve pellet in 1 ml 4M LiCl by 10 to 15 min vortexing. Pellet RNA by 5 min centrifugation.

Second Purification. Resuspend pellet in 500 µl Resuspension buffer. Add 500 µl phenol and vortex. Add 250 µl chloroform:isoamylalcohol and vortex. Spin for 5 min. and transfer supernatant to fresh tube. Repeat chloroform:isoamylalcohol extraction until interface is clear. Transfer supernatant to fresh tube and add 1/10 vol 3M NaOAc, pH 5, and 600 µl isopropanol. Keep at −20 for 20 min or longer. Pellet RNA by 10 min centrifugation. Wash pellet once with 70% ethanol. Remove all remaining alcohol before resolving pellet with 15 to 20 µl DEPC-water. Determine quantity and quality by measuring the absorbance of a 1:200 dilution at 260 and 280 nm. 40 µg RNA/ml=1OD260

RNA from wild-type of *Arabidopsis* is isolated as described (Hosein, 2001, *Plant Mol. Biol. Rep.*, 19:65a-65e; Ruuska, S. A., Girke, T., Benning, C., & Ohlrogge, J. B., 2002, *Plant Cell*, 14:1191-1206).

The mRNA is prepared from total RNA, using the Amersham Pharmacia Biotech mRNA purification kit, which utilizes oligo(dT)-cellulose columns.

Isolation of Poly-(A)+ RNA was isolated using Dyna BeadsR (Dynal, Oslo, Norway) following the instructions of the manufacturer's protocol. After determination of the concentration of the RNA or of the poly(A)+ RNA, the RNA was precipitated by addition of 1/10 volumes of 3 M sodium acetate pH 4.6 and 2 volumes of ethanol and stored at −70° C.

*Brassica napus, Glycine max* and *Oryza sativa. Brassica napus* and *Glycine max* seeds were separated from pods to create homogeneous materials for seed and seed pod cDNA libraries. Tissues were ground into fine powder under liquid N₂ using a mortar and pestle and transferred to a 50 ml tube. Tissue samples were stored at −80° C. until extractions could be performed. In the case of *Oryza sativa*, 5K-10K embryos and endosperm were isolated through dissection. Tissues were placed in small tubes or petri dishes on ice during dissection. Containers were placed on dry ice, then stored at −80° C.

Total RNA was extracted from tissues using RNeasy Maxi kit (Qiagen) according to manufacture's protocol and mRNA was processed from total RNA using Oligotex mRNA Purification System kit (Qiagen), also according to manufacture's protocol. mRNA was sent to Hyseq Pharmaceuticals Incorporated (Sunnyville, Calif.) for further processing of mRNA from each tissue type into cDNA libraries and for use in their proprietary processes, in which similar inserts in plasmids are clustered based on hybridization patterns.

Example 4 cDNA Library Construction

For cDNA library construction, first strand synthesis was achieved using Murine Leukemia Virus reverse transcriptase (Roche, Mannheim, Germany) and oligo-d(T)-primers, second strand synthesis by incubation with DNA polymerase 1, Klenow enzyme and RNAseH digestion at 12° C. (2 h), 16° C. (1 h) and 22° C. (1 h). The reaction was stopped by incubation at 65° C. (10 min) and subsequently transferred to ice. Double stranded DNA molecules were blunted by T4-DNA-polymerase (Roche, Mannheim) at 37° C. (30 min). Nucleotides were removed by phenol/chloroform extraction and Sephadex G50 spin columns. EcoRI adapters (Pharmacia, Freiburg, Germany) were ligated to the cDNA ends by T4-DNA-ligase (Roche, 12° C., overnight) and phosphorylated by incubation with polynucleotide kinase (Roche, 37° C., 30 min). This mixture was subjected to separation on a low melting agarose gel. DNA molecules larger than 300 base pairs were eluted from the gel, phenol extracted, concentrated on Elutip-D-columns (Schleicher and Schuell, Dassel, Germany) and were ligated to vector arms and packed into lambda ZAPII phages or lambda ZAP-Express phages using the Gigapack Gold Kit (Stratagene, Amsterdam, Netherlands) using material and following the instructions of the manufacturer.

*Arabidopsis thaliana, Brassica napus, Glycine max* and *Oryza sativa* cDNA libraries were generated at Hyseq Pharmaceuticals Incorporated (Sunnyville, Calif.). No amplification steps were used in the library production to retain expression information. Hyseq's genomic approach involves grouping the genes into clusters and then sequencing representative members from each cluster. cDNA libraries were generated from oligo dT column purified mRNA. Colonies from transformation of the cDNA library into *E. coli* were randomly picked and the cDNA insert were amplified by PCR and spotted on nylon membranes. A set of ³³-P radiolabeled oligonucleotides was hybridized to the clones, and the resulting hybridization pattern determined, to which cluster a particular clone belonged. cDNA clones and their DNA sequences were obtained for use in overexpression in transgenic plants and in other molecular biology processes described herein.

Example 5

Identification of LMP Genes of Interest of
*Arabidopsis thaliana, Brassica napus, Glycine max*
and *Oryza sativa*

This example illustrates how cDNA clones encoding LMP polypeptides of *Arabidopsis thaliana, Brassica napus, Gly-cine max* and *Oryza sativa* were identified and isolated. In order to identify *Arabidopsis thaliana, Brassica napus, Glycine max* and *Oryza sativa* LMP genes in propriety databases, a similarity analysis using BLAST software (Basic Local Alignment Search Tool, version 2.2.6, Altschul et al., 1997, Nucleic Acid Res. 25: 3389-3402)) was carried out. The default settings were used except for e-value cut-off (1e-10) and all protein searches were done using the BLOSUM62 matrix. The amino acid sequence of the *Arabidopsis* LMP was used as a query to search and align DNA databases from *Arabidopsis thaliana, Brassica napus, Glycine max* and *Oryza sativa* that were translated in all six reading frames, using the TBLASTN algorithm. Such similarity analysis of BPS in-house databases resulted in the identification of numerous ESTs and cDNA contigs.

RNA expression profile data obtained from the Hyseq clustering process were used to determine organ-specificity. Clones showing a greater expression in seed libraries compared to the other tissue libraries were selected as LMP candidate genes. The *Arabidopsis thaliana, Brassica napus, Glycine max* and *Oryza sativa* clones were selected for overexpression in *Arabidopsis*.

Example 6

Cloning of Full-Length cDNAs and Orthologs of
Identified LMP Genes

Clones corresponding to full-length sequences and partial cDNAs from *Arabidopsis thaliana* that were identified in Hyseq databases are isolated by RACE PCR using the SMART RACE cDNA amplification kit from Clontech allowing both 5'- and 3' rapid amplification of cDNA ends (RACE). The isolation of cDNAs and the RACE PCR protocol used are based on the manufacturer's conditions. The RACE product fragments are extracted from agarose gels with a QIAquick Gel Extraction Kit (Qiagen) and ligated into the TOPO pCR 2.1 vector (Invitrogen) following manufacturer's instructions. Recombinant vectors are transformed into TOP10 cells (Invitrogen) using standard conditions (Sambrook et al. 1989). Transformed cells are grown overnight at 37° C. on LB agar containing 50 µg/ml kanamycin and spread with 40 µl of a 40 mg/ml stock solution of X-gal in dimethylformamide for blue-white selection. Single white colonies are selected and used to inoculate 3 ml of liquid LB containing 50 µg/ml kanamycin and grown overnight at 37° C. Plasmid DNA is extracted using the QIAprep Spin Miniprep Kit (Qiagen) following manufacturer's instructions. Subsequent analyses of clones and restriction mapping are performed according to standard molecular biology techniques (Sambrook et al. 1989).

Clones of *Arabidopsis thaliana, Brassica naups, Glycine max* and *Oryza sativa* genes obtained from Hyseq were sequenced at using a ABI 377 slab gel sequencer and BigDye Terminator Ready Reaction kits (PE Biosystems, Foster City, Calif.). Gene specific primers were designed using these sequences and genes were amplified from the plasmid supplied from Hyseq using touch-down PCR. In some cases, primers were designed to add an "AACA" Kozak-like sequence just upstream of the gene start codon and two bases downstream were, in some cases, changed to GC to facilitate increased gene expression levels (Chandrashekhar et al., 1997, Plant Molecular Biology 35:993-1001). PCR reaction cycles were: 94° C., 5 min; 9 cycles of 94° C., 1 min, 65° C., 1 min, 72° C., 4 min, and in which the anneal temperature was lowered by 1° C. each cycle; 20 cycles of 94° C., 1 min, 55° C., 1 min, 72° C., 4 min; and the PCR cycle was ended with 72° C., 10 min. Amplified PCR products were gel purified from 1% agarose gels using GenElute-EtBr spin columns (Sigma) and after standard enzymatic digestion, were ligated into the plant binary vector pBPS-GB1 for transformation into *Arabidopsis thaliana* or other crops. The binary vector was amplified by overnight growth in *E. coli* DH5 in LB media and appropriate antibiotic and plasmid was prepared for downstream steps using Qiagen MiniPrep DNA preparation kit. The insert was verified throughout the various cloning steps by determining its size through restriction digest and inserts were sequenced in parallel to plant transformations to ensure the expected gene was used in *Arabidopsis thaliana* or other crop transformation.

Gene sequences can be used to identify homologous or heterologous genes (orthologs, the same LMP gene from another plant) from cDNA or genomic libraries. This can be done by designing PCR primers to conserved sequence regions identified by multiple sequence alignments. Orthologs are often identified by designing degenerate primers to full-length or partial sequences of genes of interest.

Homologous genes (e.g. full-length cDNA clones) can be isolated via nucleic acid hybridization using for example cDNA libraries: Depending on the abundance of the gene of interest, 100,000 up to 1,000,000 recombinant bacteriophages are plated and transferred to nylon membranes. After denaturation with alkali, DNA is immobilized on the membrane by, e.g., UV cross linking. Hybridization is carried out at high stringency conditions. Aqueous solution hybridization and washing is performed at an ionic strength of 1 M NaCl and a temperature of 68° C. Hybridization probes are generated by, e.g., radioactive (32P) nick transcription labeling (High Prime, Roche, Mannheim, Germany). Signals are detected by autoradiography.

Partially homologous or heterologous genes that are related but not identical can be identified in a procedure analogous to the above-described procedure using low stringency hybridization and washing conditions. For aqueous hybridization, the ionic strength is normally kept at 1 M NaCl while the temperature is progressively lowered from 68° C. to 42° C.

Isolation of gene sequences with homologies (or sequence identity/similarity) only in a distinct domain of (for example 10-20 amino acids) can be carried out by using synthetic radio labeled oligonucleotide probes. Radio labeled oligonucleotides are prepared by phosphorylation of the 5' end of two complementary oligonucleotides with T4 polynucleotide kinase. The complementary oligonucleotides are annealed and ligated to form concatemers. The double-stranded concatemers are than radiolabeled by for example nick transcription. Hybridization is normally performed at low stringency conditions using high oligonucleotide concentrations.

Oligonucleotide Hybridization Solution:
  6×SSC
  0.01 M sodium phosphate
  1 mM EDTA (pH 8)
  0.5% SDS
  100 µg/ml denatured salmon sperm DNA
  0.1% nonfat dried milk During hybridization, temperature is lowered stepwise to 5-10° C. below the estimated oligonucleotide Tm or down to room temperature followed by washing steps and autoradiography. Washing is performed with low stringency, such as 3 washing steps using 4×SSC. Further details are described by Sambrook et al. (1989, "Molecular Cloning: A Laboratory Manual," Cold Spring Harbor Laboratory Press) or Ausubel et al. (1994, "Current Protocols in Molecular Biology," John Wiley & Sons).

Example 7

Identification of Genes of Interest by Screening Expression Libraries with Antibodies c-DNA clones can be used to produce recombinant protein for example in *E. coli* (e.g. Qiagen QIAexpress pQE system). Recombinant proteins are then normally affinity purified via Ni-NTA affinity chromatography (Qiagen). Recombinant proteins can be used to produce specific antibodies for example by using standard techniques for rabbit immunization. Antibodies are affinity purified using a Ni-NTA column saturated with the recombinant antigen as described by Gu et al. (1994, BioTechniques 17:257-262). The antibody can then be used to screen expression cDNA libraries to identify homologous or heterologous genes via an immunological screening (Sambrook et al. 1989, "Molecular Cloning: A Laboratory Manual," Cold Spring Harbor Laboratory Press or Ausubel et al. 1994, "Current Protocols in Molecular Biology," John Wiley & Sons).

Example 8

Northern-Hybridization

For RNA hybridization, 20 µg of total RNA or 1 µg of poly-(A)+ RNA is separated by gel electrophoresis in 1.25% agarose gels using formaldehyde as described in Amasino (1986, Anal. Biochem. 152:304), transferred by capillary attraction using 10×SSC to positively charged nylon membranes (Hybond N+, Amersham, Braunschweig), immobilized by UV light and pre-hybridized for 3 hours at 68° C. using hybridization buffer (10% dextran sulfate w/v, 1 M NaCl, 1% SDS, 100 µg/ml of herring sperm DNA). The labeling of the DNA probe with the Highprime DNA labeling kit (Roche, Mannheim, Germany) is carried out during the pre-hybridization using alpha-32P dCTP (Amersham, Braunschweig, Germany). Hybridization is carried out after addition of the labeled DNA probe in the same buffer at 68° C. overnight. The washing steps are carried out twice for 15 min using 2×SSC and twice for 30 min using 1×SSC, 1% SDS at 68° C. The exposure of the sealed filters is carried out at −70° C. for a period of 1 day to 14 days.

Example 9

DNA Sequencing and Computational Functional Analysis cDNA libraries can be used for DNA sequencing according to standard methods, in particular by the chain termination method using the ABI PRISM Big Dye Terminator Cycle Sequencing Ready Reaction Kit (Perkin-Elmer, Weiterstadt, Germany). Random sequencing can be carried out subsequent to preparative plasmid recovery from cDNA libraries via in vivo mass excision, retransformation, and subsequent plating of DH10B on agar plates (material and protocol details from Stratagene, Amsterdam, Netherlands). Plasmid DNA can be prepared from overnight grown *E. coli* cultures grown in Luria-Broth medium containing ampicillin (see Sambrook et al. (1989, Cold Spring Harbor Laboratory Press: ISBN 0-87969-309-6) on a Qiagene DNA preparation robot (Qiagen, Hilden) according to the manufacturer's protocols). Sequences can be processed and annotated using the software package EST-MAX commercially provided by Bio-Max (Munich, Germany). The program incorporates bioinformatics methods important for functional and structural characterization of protein sequences. For reference see http://pedant.mips.biochem.mpg.de.

The most important algorithms incorporated in EST-MAX are: FASTA: Very sensitive protein sequence database searches with estimates of statistical significance (Pearson W. R. 1990, Rapid and sensitive sequence comparison with FASTP and FASTA. Methods Enzymol. 183:63-98). BLAST: Very sensitive protein sequence database searches with estimates of statistical significance (Altschul S. F., Gish W., Miller W., Myers E. W. and Lipman D. J. Basic local alignment search tool. J. Mol. Biol. 215:403-410). PREDATOR: High-accuracy secondary structure prediction from single and multiple sequences. (Frishman & Argos 1997, 75% accuracy in protein secondary structure prediction. Proteins 27:329-335). CLUSTALW: Multiple sequence alignment (Thompson, J. D., Higgins, D. G. and Gibson, T. J. 1994, "CLUSTAL W: improving the sensitivity of progressive multiple sequence alignment through sequence weighting, positions-specific gap penalties and weight matrix choice," Nucleic Acids Res. 22:4673-4680). TMAP: Transmembrane region prediction from multiply aligned sequences (Persson B. & Argos P. 1994, "Prediction of transmembrane segments in proteins utilizing multiple sequence alignments," J. Mol. Biol. 237:182-192). ALOM2:Transmembrane region prediction from single sequences (Klein P., Kanehisa M., and DeLisi C. 1984, "Prediction of protein function from sequence properties: A discriminant analysis of a database," Biochim. Biophys. Acta 787:221-226. Version 2 by Dr. K. Nakai). PROSEARCH: Detection of PROSITE protein sequence patterns. Kolakowski L. F. Jr., Leunissen J. A. M. and Smith J. E. 1992, "ProSearch: fast searching of protein sequences with regular expression patterns related to protein structure and function," Biotechniques 13:919-921). BLIMPS: Similarity searches against a database of ungapped blocks (Wallace & Henikoff 1992, PATMAT: A searching and extraction program for sequence, pattern and block queries and databases, CABIOS 8:249-254. Written by Bill Alford).

Example 10

Plasmids for Plant Transformation

For plant transformation binary vectors such as pBinAR can be used (Höfgen & Willmitzer 1990, Plant Sci. 66:221-230). Construction of the binary vectors can be performed by ligation of the cDNA in sense or antisense orientation into the T-DNA. 5' to the cDNA a plant promoter activates transcription of the cDNA. A polyadenylation sequence is located 3' to the cDNA. Tissue-specific expression can be achieved by using a tissue specific promoter. For example, seed-specific expression can be achieved by cloning the napin or LeB4 or USP promoter 5' to the cDNA. Also any other seed specific promoter element can be used. For constitutive expression within the whole plant the CaMV 35S promoter can be used. The expressed protein can be targeted to a cellular compartment using a signal peptide, for example for plastids, mitochondria, or endoplasmic reticulum (Kermode 1996, Crit. Rev. Plant Sci. 15:285-423). The signal peptide is cloned 5' in frame to the cDNA to achieve subcellular localization of the fusion protein.

Further examples for plant binary vectors are the pBPS-GB1, pSUN2-GW or pBPS-GB047 vectors, into which the LMP gene candidates are cloned. These binary vectors contain an antibiotic resistance gene driven under the control of the AtAct2-I promoter and a USP seed-specific promoter or a constitutive promoter in front of the candidate gene with the NOSpA terminator or the OCS terminator. Partial or full-length LMP cDNA are cloned into the multiple cloning site of the plant binary vector in sense or antisense orientation behind the USP seed-specific or PtxA promoters. The recombinant vector containing the gene of interest is transformed into Top10 cells (Invitrogen) using standard conditions. Transformed cells are selected for on LB agar containing 50 µg/ml kanamycin grown overnight at 37° C. Plasmid DNA is extracted using the QIAprep Spin Miniprep Kit (Qiagen) following manufacturer's instructions. Analysis of subsequent clones and restriction mapping is performed according to standard molecular biology techniques (Sambrook et al. 1989, Molecular Cloning, A Laboratory Manual. $2^{nd}$ Edition. Cold Spring Harbor Laboratory Press. Cold Spring Harbor, N.Y.).

Example 11

Agrobacterium Mediated Plant Transformation

Agrobacterium mediated plant transformation with the LMP nucleic acids described herein can be performed using standard transformation and regeneration techniques (Gelvin, Stanton B. & Schilperoort R. A, Plant Molecular Biology Manual, 2nd ed. Kluwer Academic Publ., Dordrecht 1995 in Sect., Ringbuc Zentrale Signatur: BT11-P; Glick, Bernard R. and Thompson, John E. Methods in Plant Molecular Biology and Biotechnology, S. 360, CRC Press, Boca Raton 1993). For example, Agrobacterium mediated transformation can be performed using the GV3 (pMP90) (Koncz & Schell, 1986, Mol. Gen. Genet. 204:383-396) or LBA4404 (Clontech) Agrobacterium tumefaciens strain.

Arabidopsis thaliana can be grown and transformed according to standard conditions (Bechtold 1993, Acad. Sci. Paris. 316:1194-1199; Bent et al. 1994, Science 265:1856-1860). Additionally, rapeseed can be transformed with the LMR nucleic acids of the present invention via cotyledon or hypocotyl transformation (Moloney et al. 1989, Plant Cell Report 8:238-242; De Block et al. 1989, Plant Physiol. 91:694-701). Use of antibiotic for Agrobacterium and plant selection depends on the binary vector and the Agrobacterium strain used for transformation. Rapeseed selection is normally performed using a selectable plant marker. Additionally, Agrobacterium mediated gene transfer to flax can be performed using, for example, a technique described by Mlynarova et al. (1994, Plant Cell Report 13:282-285).

The LMP genes from various plant species were cloned into a binary vector and expressed either under a constitutive promoter like the superpromoter (Stanton B. Gelvin, U.S. Pat. No. 5,428,147 and U.S. Pat. No. 5,217,903) or seed-specific promoters like USP (unknown seed protein) from Vicia faba (Baeumlein et al. 1991, Mol. Gen. Genetics 225:459-67), or the legumin B4 promoter (LeB4; Baeumlein et al. 1992, Plant J. 2:233-239) as well as promoters conferring seed-specific expression in monocot plants like maize, barley, wheat, rye, rice etc. were used.

Transformation of soybean can be performed using for example a technique described in EP 0424047, U.S. Pat. No. 5,322,783 (Pioneer Hi-Bred International) or in EP 0397687, U.S. Pat. No. 5,376,543, or U.S. Pat. No. 5,169,770 (University Toledo), or by any of a number of other transformation procedures known in the art. Soybean seeds are surface sterilized with 70% ethanol for 4 minutes at room temperature with continuous shaking, followed by 20% (v/v) CLOROX supplemented with 0.05% (v/v) TWEEN for 20 minutes with continuous shaking. Then the seeds are rinsed 4 times with distilled water and placed on moistened sterile filter paper in a Petri dish at room temperature for 6 to 39 hours. The seed coats are peeled off, and cotyledons are detached from the embryo axis. The embryo axis is examined to make sure that the meristematic region is not damaged. The excised embryo axes are collected in a half-open sterile Petri dish and air-dried to a moisture content less than 20% (fresh weight) in a sealed Petri dish until further use.

The method of plant transformation is also applicable to *Brassica napus* and other crops. In particular, seeds of canola are surface sterilized with 70% ethanol for 4 minutes at room temperature with continuous shaking, followed by 20% (v/v) CLOROX supplemented with 0.05% (v/v) TWEEN for 20 minutes, at room temperature with continuous shaking. Then, the seeds are rinsed 4 times with distilled water and placed on moistened sterile filter paper in a Petri dish at room temperature for 18 hours. The seed coats are removed and the seeds are air dried overnight in a half-open sterile Petri dish. During this period, the seeds lose approximately 85% of their water content. The seeds are then stored at room temperature in a sealed Petri dish until further use. *Agrobacterium tumefaciens* culture is prepared from a single colony in LB solid medium plus appropriate antibiotics (e.g. 100 mg/l streptomycin, 50 mg/l kanamycin) followed by growth of the single colony in liquid LB medium to an optical density at 600 nm of 0.8. Then, the bacteria culture is pelleted at 7000 rpm for 7 minutes at room temperature, and re-suspended in MS (Murashige & Skoog 1962, Physiol. Plant. 15:473-497) medium supplemented with 100 mM acetosyringone. Bacteria cultures are incubated in this pre-induction medium for 2 hours at room temperature before use. The axis of soybean zygotic seed embryos at approximately 44% moisture content are imbibed for 2 h at room temperature with the pre-induced *Agrobacterium* suspension culture. (The imbibition of dry embryos with a culture of *Agrobacterium* is also applicable to maize embryo axes). The embryos are removed from the imbibition culture and are transferred to Petri dishes containing solid MS medium supplemented with 2% sucrose and incubated for 2 days, in the dark at room temperature. Alternatively, the embryos are placed on top of moistened (liquid MS medium) sterile filter paper in a Petri dish and incubated under the same conditions described above. After this period, the embryos are transferred to either solid or liquid MS medium supplemented with 500 mg/l carbenicillin or 300 mg/l cefotaxime to kill the *agrobacteria*. The liquid medium is used to moisten the sterile filter paper. The embryos are incubated during 4 weeks at 25° C., under 440 μmol photons $m^{-2} s^{-1}$ and 12 hours photoperiod. Once the seedlings have produced roots, they are transferred to sterile metromix soil. The medium of the in vitro plants is washed off before transferring the plants to soil. The plants are kept under a plastic cover for 1 week to favor the acclimatization process. Then the plants are transferred to a growth room where they are incubated at 25° C., under 440 μmol $m^{-2} s^{-1}$ light intensity and 12 h photoperiod for about 80 days.

Samples of the primary transgenic plants ($T_0$) are analyzed by PCR to confirm the presence of T-DNA. These results are confirmed by Southern hybridization wherein DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labeled probe by PCR as recommended by the manufacturer.

As an example for monocot transformation, the construction of ptxA promoter (PF 55368-2 US, Song H. et al., 2004, application not yet published) in combination with maize Ubiquitin intron and LMP nucleic acid molecules is described. The PtxA-LMP gene construct in pUC is digested with PacI and XmaI. pBPSMM348 is digested with PacI and XmaI to isolate maize Ubiquitin intron (ZmUbi intron) followed by electrophoresis and the QIAEX II Gel Extraction Kit (cat #20021). The ZmUbi intron is ligated into the PtxA-pk331AT01 or PtxA-pk331OS37109650 nucleic acid molecule in pUC to generate pUC based PtxA-ZmUbi intron-PCT or PCT-like nucleic acid molecule construct followed by restriction enzyme digestion with AfeI and PmeI. PtxA-ZmUbi intron LMP gene cassette is cut out of a Seaplaque low melting temperature agarose gel (SeaPlaque®GTG® Agarose catalog No. 50110) after electrophoresis. A monocotyledonous base vector containing a selectable marker cassette (Monocot base vector) is digested with PmeI. The LMP nucleic acid molecule expression cassette containing ptxA promoter-ZmUbi intron is ligated into the Monocot base vector to generate PtxA-ZmUbi intron-LMP nucleic acid molecule construct. Subsequently, the PtxA-ZmUbi intron-LMP nucleic acid molecule construct is transformed into a recombinant LBA4404 strain containing pSB1 (super vir plasmid) using electroporation following a general protocol in the art. *Agrobacterium*-mediated transformation in maize is performed using immature embryo following a protocol described in U.S. Pat. No. 5,591,616. An imidazolinone herbicide selection is applied to obtain transgenic maize lines.

In general, a rice (or other monocot) LMP gene under a plant promoter, like super promoter, could be transformed into corn, or another crop plant, to generate effects of monocot LMP genes in other monocots, or dicot LMP genes in other dicots, or monocot genes in dicots, or vice versa. The plasmids containing these LMP coding sequences, 5' of a promoter and 3' of a terminator would be constructed in a manner similar to those described for construction of other plasmids herein.

Example 12

In Vivo Mutagenesis

In vivo mutagenesis of microorganisms can be performed by incorporation and passage of the plasmid (or other vector) DNA through *E. coli* or other microorganisms (e.g. *Bacillus* spp. or yeasts such as *Saccharomyces cerevisiae*) that are impaired in their capabilities to maintain the integrity of their genetic information. Typical mutator strains have mutations in the genes for the DNA repair system (e.g., mutHLS, mutD, mutT, etc.; for reference, see Rupp W. D. 1996, "DNA repair mechanisms," in: *Escherichia coli* and *Salmonella*, p. 2277-2294, ASM: Washington.) Such strains are well known to those skilled in the art. The use of such strains is illustrated, for example, in Greener and Callahan 1994, Strategies 7:32-34. Transfer of mutated DNA molecules into plants is preferably done after selection and testing in microorganisms. Transgenic plants are generated according to various examples within the exemplification of this document.

Example 13

Assessment of the mRNA Expression and Activity of a Recombinant Gene Product in the Transformed Organism The activity of a recombinant gene product in the transformed host organism can be measured on the transcriptional or/and on the translational level. A useful method to ascertain the level of transcription of the gene (an indicator of the amount of mRNA available for translation to the gene product) is to perform a Northern blot (for reference see, for example, Ausubel et al. 1988, Current Protocols in Molecular Biology, Wiley: New York), in which a primer designed to bind to the gene of interest is labeled with a detectable tag (usually radioactive or chemiluminescent), such that when the total RNA of a culture of the organism is extracted, run on gel, transferred to a stable matrix and incubated with this probe, the binding and quantity of binding of the probe indicates the presence and also the quantity of mRNA for this gene. This information at least partially demonstrates the degree of transcription of the transformed gene. Total cellular RNA can be prepared from plant cells, tissues or organs by several methods, all well-known in the art, such as that described in Bormann et al. (1992, Mol. Microbiol. 6:317-326).

To assess the presence or relative quantity of protein translated from this mRNA, standard techniques, such as a Western blot, may be employed (see, for example, Ausubel et al. 1988, Current Protocols in Molecular Biology, Wiley: New York). In this process, total cellular proteins are extracted, separated by gel electrophoresis, transferred to a matrix such as nitrocellulose, and incubated with a probe, such as an antibody, which specifically binds to the desired protein. This probe is generally tagged with a chemiluminescent or calorimetric label, which may be readily detected. The presence and quantity of label observed indicates the presence and quantity of the desired mutant protein present in the cell.

The activity of LMPs that bind to DNA can be measured by several well-established methods, such as DNA band-shift assays (also called gel retardation assays). The effect of such LMP on the expression of other molecules can be measured using reporter gene assays (such as that described in Kolmar H. et al. 1995, EMBO J. 14:3895-3904 and references cited therein). Reporter gene test systems are well known and established for applications in both prokaryotic and eukaryotic cells, using enzymes such as beta-galactosidase, green fluorescent protein, and several others.

The determination of activity of lipid metabolism membrane-transport proteins can be performed according to techniques such as those described in Gennis R. B. (1989 Pores, Channels and Transporters, in Biomembranes, Molecular Structure and Function, Springer: Heidelberg, pp. 85-137, 199-234 and 270-322).

Example 14

In Vitro Analysis of the Function of *Arabidopsis thaliana, Brassica napus, Glycine max* and *Oryza sativa* LMP Genes in Transgenic Plants The determination of activities and kinetic parameters of enzymes is well established in the art. Experiments to determine the activity of any given altered enzyme must be tailored to the specific activity of the wild-type enzyme, which is well within the ability of one skilled in the art. Overviews about enzymes in general, as well as specific details concerning structure, kinetics, principles, methods, applications and examples for the determination of many enzyme activities may be found, for example, in the following references: Dixon, M. & Webb, E. C. 1979, Enzymes. Longmans: London; Fersht, (1985) Enzyme Structure and Mechanism. Freeman: New York; Walsh (1979) Enzymatic Reaction Mechanisms. Freeman: San Francisco; Price, N.C., Stevens, L. (1982) Fundamentals of Enzymology. Oxford Univ. Press: Oxford; Boyer, P. D., ed. (1983) The Enzymes, 3rd ed. Academic Press: New York; Bisswanger, H., (1994) Enzymkinetik, 2nd ed. VCH: Weinheim (ISBN 3527300325); Bergmeyer, H. U., Bergmeyer, J., Graβl, M., eds. (1983-1986) Methods of Enzymatic Analysis, 3rd ed., vol. I-XII, Verlag Chemie: Weinheim; and Ullmann's Encyclopedia of Industrial Chemistry (1987) vol. A9, Enzymes. VCH: Weinheim, p. 352-363. For a more specific example for purification, preparation of membrane fractions, kinetic analyses and assay of PCT activities see, for example, Marechal E, et al. (1997, Physiol. Plant. 100:65-77) and literature cited therein.

Example 15

Analysis of the Impact of Recombinant Proteins on the Production of a Desired Seed Storage Compound

*Arabidopsis* was used to investigate the influence of LMP genes on seed storage compound accumulation. Seeds from transformed *Arabidopsis thaliana* plants were analyzed by gas chromatography (GC) for total oil content and fatty acid profile. Total fatty acid content of seeds of control and transgenic plants were measured with bulked seeds (usually 5 mg seed weight) of a single plant. Three different types of controls have been used: Col-2 (Columbia-2, the *Arabidopsis* ecotypes LMP gene of interest have been transformed in), C-24 (an *Arabidopsis* ecotype found to accumulate high amounts of total fatty acids in seeds, used as a positive control herein) and BPS empty (without LMP gene of interest) binary vector construct. The controls indicated in the tables below have been grown side by side with the transgenic lines. Differences in the total values of the controls between different batches are explained by differences in the growth conditions, which were found to be very sensitive to small variations in the plant cultivation. Because of the seed bulking all values obtained with T2 seeds are the result of a mixture of homozygous (for the gene of interest), heterozygous events and wild type seeds, implying that these data underestimate the potential LMP gene effect. The binary vector pBPS-GB01 containing a USP promoter driving the gene of interest has been used.

TABLE 1

Determination of the T2 seed total fatty acid content of transgenic lines of pk321AT01 (containing SEQ ID NO: 1). The gene was expressed by a seed-specific promoter. Shown are the means (±standard deviation). Average mean values are shown ± standard deviation, number of individual measurements per plant line: 8-10; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control. Transgenic seeds of pk321AT01 show a significant increase relative to the empty vector control seeds (p < 0.05 as obtained by Student's t-test).

| Genotype | g total fatty acids/g seed weight |
|---|---|
| C-24 wild-type seeds | 0.305 ± 0.022 |
| Col-2 wild-type seeds | 0.256 ± 0.043 |
| Empty vector control seeds | 0.256 ± 0.035 |
| pk321AT01 transgenic seeds | 0.321 ± 0.019 |

TABLE 2

Determination of the T2 seed total fatty acid content of transgenic lines of pk322AT01 (containing SEQ ID NO: 63). The gene was expressed by a seed-specific promoter. Shown are the means (±standard deviation). Average mean values are shown ± standard deviation, number of individual measurements per plant line: 8-20; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control. Transgenic seeds of pk322AT01 show a significant increase relative to the empty vector control seeds ($p < 0.05$ as obtained by Student's t-test).

| Genotype | g total fatty acids/g seed weight |
| --- | --- |
| C-24 wild-type seeds | 0.305 ± 0.022 |
| Col-2 wild-type seeds | 0.256 ± 0.043 |
| Empty vector control seeds | 0.256 ± 0.035 |
| pk322AT01 transgenic seeds | 0.325 ± 0.025 |

TABLE 3

Determination of the T2 seed total fatty acid content of transgenic lines of pk323AT01 (containing SEQ ID NO: 87). The gene was expressed by a seed-specific promoter. Shown are the means (±standard deviation). Average mean values are shown ± standard deviation, number of individual measurements per plant line: 8-20; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control. Transgenic seeds of pk323AT01 show a significant increase relative to the empty vector control seeds ($p < 0.05$ as obtained by Student's t-test).

| Genotype | g total fatty acids/ g seed weight |
| --- | --- |
| C-24 wild-type seeds | 0.305 ± 0.022 |
| Col-2 wild-type seeds | 0.256 ± 0.043 |
| Empty vector control seeds | 0.256 ± 0.035 |
| pk323AT01 transgenic seeds | 0.299 ± 0.025 |

TABLE 4

Determination of the T2 seed total fatty acid content of transgenic lines of pk324AT01 (containing SEQ ID NO: 158). The gene was expressed by a seed-specific promoter. Shown are the means (±standard deviation). Average mean values are shown ± standard deviation, number of individual measurements per plant line: 6-8; Col-2 is the *Arabidopsis* ecotype the LMP gene has been transformed in, empty vector control is Col-2 transformed with a binary vector without gene of interest.

| Genotype | g total fatty acids/ g seed weight |
| --- | --- |
| Col-2 wild-type seeds | 0.311 ± 0.021 |
| Empty vector control seeds | 0.324 ± 0.019 |
| pk324AT01 transgenic seeds | 0.334 ± 0.011 |

TABLE 5

Determination of the T2 seed total fatty acid content of transgenic lines of pk325AT01 (containing SEQ ID NO: 238). The gene was expressed by a seed-specific promoter. Shown are the means (±standard deviation). Average mean values are shown ± standard deviation, number of individual measurements per plant line: 6-10; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control. Transgenic seeds of pk325AT01 show a significant increase relative to the empty vector control seeds ($p < 0.05$ as obtained by Student's t-test).

| Genotype | g total fatty acids/ g seed weight |
| --- | --- |
| C-24 wild-type seeds | 0.318 ± 0.017 |
| Col-2 wild-type seeds | 0.299 ± 0.013 |
| Empty vector control seeds | 0.304 ± 0.023 |
| pk325AT01 transgenic seeds | 0.329 ± 0.010 |

TABLE 6

Determination of the T2 seed total fatty acid content of transgenic lines of pk326AT01 (containing SEQ ID NO: 273). The gene was expressed by a seed-specific promoter. Shown are the means (±standard deviation). Average mean values are shown ± standard deviation, number of individual measurements per plant line: 6-10; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control. Transgenic seeds of pk326AT01 show a significant increase relative to the empty vector control seeds ($p < 0.05$ as obtained by Student's t-test).

| Genotype | g total fatty acids/ g seed weight |
| --- | --- |
| C-24 wild-type seeds | 0.318 ± 0.017 |
| Col-2 wild-type seeds | 0.299 ± 0.013 |
| Empty vector control seeds | 0.304 ± 0.023 |
| pk326AT01 transgenic seeds | 0.345 ± 0.010 |

TABLE 7

Determination of the T2 seed total fatty acid content of transgenic lines of pk328AT01 (containing SEQ ID NO: 552). The gene was expressed by a seed-specific promoter. Shown are the means (±standard deviation). Average mean values are shown ± standard deviation, number of individual measurements per plant line: 6-20; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control. Transgenic seeds of pk328AT01 show a significant increase relative to the empty vector control seeds ($p < 0.05$ as obtained by Student's t-test).

| Genotype | g total fatty acids/ g seed weight |
| --- | --- |
| C-24 wild-type seeds | 0.306 ± 0.021 |
| Col-2 wild-type seeds | 0.279 ± 0.032 |
| Empty vector control seeds | 0.257 ± 0.033 |
| pk328AT01 transgenic seeds | 0.312 ± 0.033 |

TABLE 8a

Determination of the T2 and T3 seed total fatty acid content of transgenic lines of pk329AT01 (containing SEQ ID NO: 591). The gene was expressed by a seed specific promoter. Shown are the means (±standard deviation). Average mean values are shown ± standard deviation, number of individual measurements per plant line: 6-20; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control. Transgenic seeds of pk329AT01 show a significant increase relative to the empty vector control seeds ($p < 0.05$ as obtained by Student's t-test).

| Genotype | g total fatty acids/ g seed weight |
|---|---|
| T2 data: | |
| C-24 wild-type seeds | 0.306 ± 0.021 |
| Col-2 wild-type seeds | 0.279 ± 0.032 |
| Empty vector control seeds | 0.257 ± 0.033 |
| pk329AT01 transgenic seeds | 0.305 ± 0.028 |
| T3 data: | |
| C-24 wild-type seeds | 0.343 ± 0.017 |
| Col-2 wild-type seeds | 0.328 ± 0.028 |
| Empty vector control seeds | 0.314 ± 0.024 |
| pk329AT01-0957 transgenic seeds | 0.343 ± 0.016 |
| pk329AT01-1114 transgenic seeds | 0.345 ± 0.020 |

TABLE 8b

Determination of the T3 seed total fatty acid content of transgenic lines of pk329AT01 (containing SEQ ID NO: 591). The gene was expressed by a constitutive promoter. Shown are the means (±standard deviation). Average mean values are shown ± standard deviation, number of individual measurements per plant line: 6-20; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control. Transgenic seeds of pk329AT01 show a significant increase relative to the empty vector control seeds ($p < 0.05$ as obtained by Student's t-test).

| Genotype | g total fatty acids/ g seed weight |
|---|---|
| C-24 wild-type seeds | 0.299 ± 0.020 |
| Col-2 wild-type seeds | 0.257 ± 0.038 |
| Empty vector control seeds | 0.280 ± 0.035 |
| pk329AT01-1232 transgenic seeds | 0.298 ± 0.045 |
| pk329AT01-1258 transgenic seeds | 0.325 ± 0.040 |

TABLE 9a

Determination of the T2 seed total fatty acid content of transgenic lines of pk331AT01 (containing SEQ ID NO: 625). The gene was expressed by a seed-specific promoter. Shown are the means (±standard deviation). Average mean values are shown ± standard deviation, number of individual measurements per plant line: 6-25; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control. Transgenic seeds of pk331AT01 show a significant increase relative to the empty vector control seeds ($p < 0.05$ as obtained by Student's t-test).

| Genotype | g total fatty acids/ g seed weight |
|---|---|
| C-24 wild-type seeds | 0.306 ± 0.021 |
| Col-2 wild-type seeds | 0.279 ± 0.032 |
| Empty vector control seeds | 0.257 ± 0.033 |
| pk331AT01 transgenic seeds | 0.312 ± 0.027 |

TABLE 9b

Determination of the T3 seed total fatty acid content of transgenic lines of pk331AT01 (containing SEQ ID NO: 625). The gene was expressed by a constitutive promoter. Shown are the means (±standard deviation). Average mean values are shown ± standard deviation, number of individual measurements per plant line: 6-25; Col-2 is the *Arabidopsis* ecotype the LMP gene has been transformed in, empty vector control is Col-2 transformed with a binary vector without gene of interest, C-24 is a high-oil *Arabidopsis* ecotype used as another positive control.

| Genotype | g total fatty acids/ g seed weight |
|---|---|
| C-24 wild-type seeds | 0.299 ± 0.020 |
| Col-2 wild-type seeds | 0.257 ± 0.038 |
| Empty vector control seeds | 0.287 ± 0.054 |
| pk331AT01-1193 transgenic seeds | 0.300 ± 0.038 |

TABLE 10

Determination of the T2 seed total fatty acid content of transgenic lines of pk320BN 51431102 (containing SEQ ID NO: 681). The gene was expressed by a seed-specific promoter. Shown are the means (±standard deviation). Average mean values are shown ± standard deviation, number of individual measurements per plant line: 8-20; Col-2 is the *Arabidopsis* ecotype the LMP gene has been transformed in, empty vector control is Col-2 transformed with a binary vector without gene of interest. Transgenic seeds of pk320BN51431102 show a significant increase relative to the empty vector control seeds ($p < 0.05$ as obtained by Student's t-test).

| Genotype | g total fatty acids/ g seed weight |
|---|---|
| Col-2 wild-type seeds | 0.331 ± 0.014 |
| Empty vector control seeds | 0.321 ± 0.025 |
| pk320BN 51431102 transgenic seeds | 0.352 ± 0.013 |

TABLE 11

Determination of the T2 seed total fatty acid content of transgenic lines of pk320GM59682267 (containing SEQ ID NO: 659). The gene was expressed by a seed-specific promoter. Shown are the means (±standard deviation). Average mean values are shown ± standard deviation, number of individual measurements per plant line: 5-8; empty vector control is Col-2 transformed with a binary vector without gene of interest, C-24 is a high-oil *Arabidopsis* ecotype used as another positive control. Transgenic seeds of pk320GM59682267 show a significant increase relative to the empty vector control seeds ($p < 0.05$ as obtained by Student's t-test).

| Genotype | g total fatty acids/ g seed weight |
|---|---|
| C-24 wild-type seeds | 0.303 ± 0.044 |
| Empty vector control seeds | 0.293 ± 0.031 |
| pk320GM59682267 transgenic seeds | 0.345 ± 0.029 |

TABLE 12

Determination of the T2 seed total fatty acid content of transgenic lines of pk316BN 44215842 (containing SEQ ID NO: 778). The gene was expressed by a seed-specific promoter. Shown are the means (±standard deviation). Average mean values are shown ± standard deviation, number of individual measurements per plant line: 5-8; Col-2 is the *Arabidopsis* ecotype the LMP gene has been transformed in, C-24 is a high-oil *Arabidopsis* ecotype used as another positive control. Transgenic seeds of pk316BN44215842 show a significant increase relative to the empty vector control seeds ($p < 0.05$ as obtained by Student's t-test).

| Genotype | g total fatty acids/ g seed weight |
| --- | --- |
| C-24 wild-type seeds | 0.339 ± 0.022 |
| Col-2 wild-type seeds | 0.316 ± 0.011 |
| pk316BN 44215842 transgenic seeds | 0.340 ± 0.017 |

The effect of the genetic modification in plants on a desired seed storage compound (such as a sugar, lipid or fatty acid) can be assessed by growing the modified plant under suitable conditions and analyzing the seeds or any other plant organ for increased production of the desired product (i.e., a lipid or a fatty acid). Such analysis techniques are well known to one skilled in the art, and include spectroscopy, thin layer chromatography, staining methods of various kinds, enzymatic and microbiological methods, and analytical chromatography such as high performance liquid chromatography (see, for example, Ullman 1985, Encyclopedia of Industrial Chemistry, vol. A2, pp. 89-90 and 443-613, VCH: Weinheim; Fallon, A. et al. 1987, Applications of HPLC in Biochemistry in: Laboratory Techniques in Biochemistry and Molecular Biology, vol. 17; Rehm et al., 1993 Product recovery and purification, Biotechnology, vol. 3, Chapter III, pp. 469-714, VCH: Weinheim; Belter, P. A. et al., 1988 Bioseparations: downstream processing for biotechnology, John Wiley & Sons; Kennedy J. F. & Cabral J. M. S. 1992, Recovery processes for biological materials, John Wiley and Sons; Shaeiwitz J. A. & Henry J. D. 1988, Biochemical separations in: Ulmann's Encyclopedia of Industrial Chemistry, Separation and purification techniques in biotechnology, vol. B3, Chapter 11, pp. 1-27, VCH: Weinheim; and Dechow F. J. 1989).

Besides the above-mentioned methods, plant lipids are extracted from plant material as described by Cahoon et al. (1999, Proc. Natl. Acad. Sci. USA 96, 22:12935-12940) and Browse et al. (1986, Anal. Biochemistry 442:141-145). Qualitative and quantitative lipid or fatty acid analysis is described in Christie, William W., Advances in Lipid Methodology. Ayr/Scotland: Oily Press.—(Oily Press Lipid Library; Christie, William W., Gas Chromatography and Lipids. A Practical Guide—Ayr, Scotland: Oily Press, 1989 Repr. 1992.—IX, 307 S.—(Oily Press Lipid Library; and "Progress in Lipid Research, Oxford: Pergamon Press, 1 (1952)-16 (1977) Progress in the Chemistry of Fats and Other Lipids CODEN.

Unequivocal proof of the presence of fatty acid products can be obtained by the analysis of transgenic plants following standard analytical procedures: GC, GC-MS or TLC as variously described by Christie and references therein (1997 in: Advances on Lipid Methodology 4th ed.: Christie, Oily Press, Dundee, pp. 119-169; 1998). Detailed methods are described for leaves by Lemieux et al. (1990, Theor. Appl. Genet. 80:234-240) and for seeds by Focks & Benning (1998, Plant Physiol. 118:91-101).

Positional analysis of the fatty acid composition at the sn-1, sn-2 or sn-3 positions of the glycerol backbone is determined by lipase digestion (see, e.g., Siebertz & Heinz 1977, Z. Naturforsch. 32c:193-205, and Christie 1987, Lipid Analysis $2^{nd}$ Edition, Pergamon Press, Exeter, ISBN 0-08-023791-6).

Total seed oil levels can be measured by any appropriate method. Quantitation of seed oil contents is often performed with conventional methods, such as near infrared analysis (NIR) or nuclear magnetic resonance imaging (NMR). NIR spectroscopy has become a standard method for screening seed samples whenever the samples of interest have been amenable to this technique. Samples studied include canola, soybean, maize, wheat, rice, and others. NIR analysis of single seeds can be used (see e.g. Velasco et al., "Estimation of seed weight, oil content and fatty acid composition in intact single seeds of rapeseed (*Brassica napus* L.) by near-infrared reflectance spectroscopy," Euphytica, Vol. 106, 1999, pp. 79-85). NMR has also been used to analyze oil content in seeds (see e.g. Robertson & Morrison, "Analysis of oil content of sunflower seed by wide-line NMR," Journal of the American Oil Chemists Society, 1979, Vol. 56, 1979, pp. 961-964, which is herein incorporated by reference in its entirety).

A typical way to gather information regarding the influence of increased or decreased protein activities on lipid and sugar biosynthetic pathways is for example via analyzing the carbon fluxes by labeling studies with leaves or seeds using $^{14}C$-acetate or $^{14}C$-pyruvate (see, e.g. Focks & Benning 1998, Plant Physiol. 118:91-101; Eccleston & Ohlrogge 1998, Plant Cell 10:613-621). The distribution of carbon-14 into lipids and aqueous soluble components can be determined by liquid scintillation counting after the respective separation (for example on TLC plates) including standards like $^4C$-sucrose and $^{14}C$-malate (Eccleston & Ohlrogge 1998, Plant Cell 10:613-621).

Material to be analyzed can be disintegrated via sonication, glass milling, liquid nitrogen, and grinding or via other applicable methods. The material has to be centrifuged after disintegration. The sediment is re-suspended in distilled water, heated for 10 minutes at 100° C., cooled on ice and centrifuged again followed by extraction in 0.5 M sulfuric acid in methanol containing 2% dimethoxypropane for 1 hour at 90° C. leading to hydrolyzed oil and lipid compounds resulting in transmethylated lipids. These fatty acid methyl esters are extracted in petrolether and finally subjected to GC analysis using a capillary column (Chrompack, WCOT Fused Silica, CP-Wax-52 CB, 25 m, 0.32 mm) at a temperature gradient between 170° C. and 240° C. for 20 minutes and 5 min. at 240° C. The identity of resulting fatty acid methylesters is defined by the use of standards available form commercial sources (i.e., Sigma).

In case of fatty acids where standards are not available, molecule identity is shown via derivatization and subsequent GC-MS analysis. For example, the localization of triple bond fatty acids is shown via GC-MS after derivatization via 4,4-Dimethoxy-oxazolin-Derivaten (Christie, Oily Press, Dundee, 1998).

A common standard method for analyzing sugars, especially starch, is published by Stitt M., Lilley R. Mc. C., Gerhardt R. and Heldt M. W. (1989, "Determination of metabolite levels in specific cells and subcellular compartments of plant leaves," Methods Enzymol. 174:518-552; for other methods see also Härtel et al. 1998, Plant Physiol. Biochem. 36:407-417 and Focks & Benning 1998, Plant Physiol. 118:91-101). For the extraction of soluble sugars and starch, 50 seeds are homogenized in 500 µl of 80% (v/v) ethanol in a 1.5-ml polypropylene test tube and incubated at 70° C. for 90 min. Following centrifugation at 16,000 g for 5 min, the supernatant is transferred to a new test tube. The pellet is extracted twice with 500 µl of 80% ethanol. The solvent of the combined supernatants is evaporated at room temperature under a vacuum. The residue is dissolved in 50 µl of water, representing the soluble carbohydrate fraction. The pellet left from the ethanol extraction, which contains the insoluble carbohydrates including starch, is homogenized in 200 µl of 0.2 N KOH, and the suspension is incubated at 95° C. for 1 h to dissolve the starch. Following the addition of 35 µl of 1 N acetic acid and centrifugation for 5 min at 16,000 g, the supernatant is used for starch quantification.

To quantify soluble sugars, 10 µl of the sugar extract is added to 990 µl of reaction buffer containing 100 mM imidazole, pH 6.9, 5 mM $MgCl_2$, 2 mM NADP, 1 mM ATP, and 2 units 2 $ml^{-1}$ of Glucose-6-P-dehydrogenase. For enzymatic determination of glucose, fructose, and sucrose, 4.5 units of hexokinase, 1 unit of phosphoglucoisomerase, and 2 µl of a saturated fructosidase solution are added in succession. The production of NADPH is photometrically monitored at a wavelength of 340 nm. Similarly, starch is assayed in 30 µl of the insoluble carbohydrate fraction with a kit from Boehringer Mannheim.

An example for analyzing the protein content in leaves and seeds can be found by Bradford M. M. (1976, "A rapid and sensitive method for the quantification of microgram quantities of protein using the principle of protein dye binding," Anal. Biochem. 72:248-254). For quantification of total seed protein, 15-20 seeds are homogenized in 250 µl of acetone in a 1.5-ml polypropylene test tube. Following centrifugation at 16,000 g, the supernatant is discarded and the vacuum-dried pellet is resuspended in 250 µl of extraction buffer containing 50 mM Tris-HCl, pH 8.0, 250 mM NaCl, 1 mM EDTA, and 1% (w/v) SDS. Following incubation for 2 h at 25° C., the homogenate is centrifuged at 16,000 g for 5 min and 200 ml of the supernatant will be used for protein measurements. In the assay, γ-globulin is used for calibration. For protein measurements, Lowry DC protein assay (Bio-Rad) or Bradford-assay (Bio-Rad) is used.

Enzymatic assays of hexokinase and fructokinase are performed spectrophotometrically according to Renz et al. (1993, Planta 190:156-165), of phosphogluco-isomerase, ATP-dependent 6-phosphofructokinase, pyrophosphate-dependent 6-phospho-fructokinase, Fructose-1,6-bisphosphate aldolase, triose phosphate isomerase, glyceral-3-P dehydrogenase, phosphoglycerate kinase, phosphoglycerate mutase, enolase and pyruvate kinase are performed according to Burrell et al. (1994, Planta 194:95-101) and of UDP-Glucose-pyrophosphorylase according to Zrenner et al. (1995, Plant J. 7:97-107).

Enzymatic activities of phosphatidate cytidylyltransferase can be determined as described (e.g. Sturton R G & Brindley D N, 1977, Biochem. J. 162:25-32; Kelley M J & Carman G M 1987, J. Biol. Chem. 262:14563-14570).

Intermediates of the carbohydrate metabolism, like glucose-1-phosphate, glucose-6-phosphate, fructose-6-phosphate, phosphoenol-pyruvate, pyruvate, and ATP are measured as described in Härtel et al. (1998, Plant Physiol. Biochem. 36:407-417) and metabolites are measured as described in Jelitto et al. (1992, Planta 188:238-244).

In addition to the measurement of the final seed storage compound (I.e., lipid, starch or storage protein) it is also possible to analyze other components of the metabolic pathways utilized for the production of a desired seed storage compound, such as intermediates and side-products, to determine the overall efficiency of production of the compound (Fiehn et al. 2000, Nature Biotech. 18:1447-1161).

For example, yeast expression vectors comprising the nucleic acids disclosed herein, or fragments thereof, can be constructed and transformed into Saccharomyces cerevisiae using standard protocols. The resulting transgenic cells can then be assayed for alterations in sugar, oil, lipid, or fatty acid contents.

Similarly, plant expression vectors comprising the nucleic acids disclosed herein, or fragments thereof, can be constructed and transformed into an appropriate plant cell such as Arabidopsis, soybean, rapeseed, rice, linseed, maize, barley, wheat, Medicago truncatula, etc., using standard protocols. The resulting transgenic cells and/or plants derived there from can then be assayed for alterations in sugar, oil, lipid, or fatty acid contents.

Additionally, the sequences disclosed herein, or fragments thereof, can be used to generate knockout mutations in the genomes of various organisms, such as bacteria, mammalian cells, yeast cells, and plant cells (Girke at al. 1998, Plant J. 15:39-48). The resultant knockout cells can then be evaluated for their composition and content in seed storage compounds, and the effect on the phenotype and/or genotype of the mutation. For other methods of gene inactivation include U.S. Pat. No. 6,004,804, "Non-Chimeric Mutational Vectors," and Puttaraju et al. (1999, "Spliceosome-mediated RNA trans-splicing as a tool for gene therapy," Nature Biotech. 17:246-252).

Example 16

Purification of the Desired Product from Transformed Organisms

An LMP can be recovered from plant material by various methods well known in the art. Organs of plants can be separated mechanically from other tissue or organs prior to isolation of the seed storage compound from the plant organ. Following homogenization of the tissue, cellular debris is removed by centrifugation and the supernatant fraction containing the soluble proteins is retained for further purification of the desired compound. If the product is secreted from cells grown in culture, then the cells are removed from the culture by low-speed centrifugation and the supernate fraction is retained for further purification.

The supernatant fraction from either purification method is subjected to chromatography with a suitable resin, in which the desired molecule is either retained on a chromatography resin while many of the impurities in the sample are not, or where the impurities are retained by the resin, while the sample is not. Such chromatography steps may be repeated as necessary, using the same or different chromatography resins. One skilled in the art would be well-versed in the selection of appropriate chromatography resins and in their most efficacious application for a particular molecule to be purified. The purified product may be concentrated by filtration or ultrafiltration, and stored at a temperature at which the stability of the product is maximized.

There is a wide array of purification methods known to the art and the preceding method of purification is not meant to be limiting. Such purification techniques are described, for example, in Bailey J. E. & Ollis D. F. 1986, Biochemical Engineering Fundamentals, McGraw-Hill: New York).

The identity and purity of the isolated compounds may be assessed by techniques standard in the art. These include high-performance liquid chromatography (HPLC), spectroscopic methods, staining methods, thin layer chromatography, analytical chromatography such as high performance liquid chromatography, NIRS, enzymatic assay, or microbiologically. Such analysis methods are reviewed in: Patek et al. (1994, Appl. Environ. Microbiol. 60:133-140), Malakhova et al. (1996, Biotekhnologiya 11:27-32) and Schmidt et al. (1998, Bioprocess Engineer 19:67-70), Ulmann's Encyclopedia of Industrial Chemistry (1996, Vol. A27, VCH: Weinheim, p. 89-90, p. 521-540, p. 540-547, p. 559-566, 575-581 and p. 581-587) and Michal G. (1999, Biochemical Pathways: An Atlas of Biochemistry and Molecular Biology, John Wiley and Sons; Fallon, A. et al. 1987, Applications of HPLC in Biochemistry in: Laboratory Techniques in Biochemistry and Molecular Biology, vol. 17).

Example 17

Screening for Increased Stress Tolerance and Plant Growth

The transgenic plants are screened for their improved stress tolerance demonstrating that transgene expression confers stress tolerance. The transgenic plants are further screened for their growth rate demonstrating that transgene expression confers increased growth rates and/or increased seed yield.

Increased seed size might be reflected in an increased seed weight of gene overexpressors. Increased seed size leads to greater yield in many economically important crop plants. Therefore, increased seed size is one goal of genetic engineering and selection using LMPs as described in this application.

For in vitro root analysis square plates measuring 12 cm×12 cm can be used. For each plate, 52 ml of MS media (0.5×MS salts, 0.5% sucrose, 0.5 g/L MES buffer, 1% Phytagar) without selection will be used. Plates will be allowed to dry in the sterile hood for one hour to reduce future condensation.

Seed aliquots will be sterilized in glass vials with ethanol for 5 minutes, the ethanol was removed, and the seeds were allowed to dry in the sterile hood for one hour.

Seeds will be spotted in the plates using the Vacuseed Device (Lehle). After the seeds were spotted on the plates, the plates will be wrapped with Ventwrap and placed vertically in racks in the dark at 4° C. for four days to stratify the seeds. The plates are transferred to a C5 Percival Growth Chamber and placed vertically. The growth chamber conditions will be 23° C. day/21° C. night and 16 h day/8 h night.

For data collection a high resolution flat-bed scanner is used. Analysis of the roots is done using the WinRhizo software package.

For soil root analysis seeds may be imbibed at 4° C. for 2 days in water and planted directly in soil with no selection. Deepots (Hummert D40) will be used with a saturated peat pellet (Jiffy 727) at the base and filled with water saturated Metromix. After planting, pots will be covered with plastic wrap to prevent drying. Plants may be grown using only water present at media preparation, as the water in the soil in these large pots is sufficient for 3 weeks of growth, and encourages rapid root growth. The plastic wrapping of the pots will be removed after 12 days and morphological data documented. At day 17 the aerial parts of the plant will be harvested, dried (65° C. for 2 days) and dry weight measured. To examine the roots the peat pellet will be pushed towards the top of the pot to remove the soil and roots as a unit. The soil will then be separated from the roots in a tray and the maximum root length will be measured. Root length of all plants for all transgenic lines will be averaged and compared against the average of the wild type plants.

TABLE 13

| Plant Lipid Classes | |
|---|---|
| Neutral Lipids | Triacylglycerol (TAG) |
| | Diacylglycerol (DAG) |
| | Monoacylglycerol (MAG) |
| Polar Lipids | Monogalactosyldiacylglycerol (MGDG) |
| | Digalactosyldiacylglycerol (DGDG) |
| | Phosphatidylglycerol (PG) |
| | Phosphatidylcholine (PC) |
| | Phosphatidylethanolamine (PE) |
| | Phosphatidylinositol (PI) |
| | Phosphatidylserine (PS) |
| | Sulfoquinovosyldiacylglycerol |

TABLE 14

| Common Plant Fatty Acids | |
|---|---|
| 16:0 | Palmitic acid |
| 16:1 | Palmitoleic acid |
| 16:3 | Palmitolenic acid |
| 18:0 | Stearic acid |
| 18:1 | Oleic acid |
| 18:2 | Linoleic acid |
| 18:3 | Linolenic acid |
| γ-18:3 | Gamma-linolenic acid* |
| 20:0 | Arachidic acid |
| 20:1 | Eicosenoic acid |
| 22:6 | Docosahexanoic acid (DHA)* |
| 20:2 | Eicosadienoic acid |
| 20:4 | Arachidonic acid (AA)* |
| 20:5 | Eicosapentaenoic acid (EPA)* |
| 22:1 | Erucic acid |

*These fatty acids do not normally occur in plant seed oils, but their production in transgenic plant seed oil is of importance in plant biotechnology.

TABLE 15

A table of the putative activities of the LMPs

| Seq ID | Sequence name | Species | Function | ORF position |
|---|---|---|---|---|
| 1 | pk321AT 01 | *Arabidopsis thaliana* | AtTPS1 gene, trehalose-6-phosphate synthase | 1-2568 |
| 63 | pk322AT 01 | *Arabidopsis thaliana* | putative pyruvate dehydrogenase E1 beta subunit | 1-1218 |
| 87 | pk323AT 01 | *Arabidopsis thaliana* | phosphate/phosphoenolpyruvate translocator like protein | 1-927 |
| 158 | pk324AT 01 | *Arabidopsis thaliana* | chloroplast NAD-dependent malate dehydrogenase | 1-1209 |
| 238 | pk325AT 01 | *Arabidopsis thaliana* | magnesium chelatase subunit of protochlorophyllide reductase | 1-1254 |
| 273 | pk326AT 01 | *Arabidopsis thaliana* | protochlorophyllide reductase precursor | 1-1203 |
| 321 | pk327AT 01 | *Arabidopsis thaliana* | putative photosystem II type I chlorophyll a/b binding protein | 1-798 |

TABLE 15-continued

A table of the putative activities of the LMPs

| Seq ID | Sequence name | Species | Function | ORF position |
|---|---|---|---|---|
| 552 | pk328AT 01 | Arabidopsis thaliana | chlorophyll a/b-binding protein CP29 | 1-870 |
| 591 | pk329AT 01 | Arabidopsis thaliana | CHLOROPHYLL A-B BINDING PROTEIN 4 PRECURSOR homolog | 1-753 |
| 625 | pk331AT 01 | Arabidopsis thaliana | Arabidopsis thaliana chlorophyll a oxygenase (CAO)/chlorophyll b synthase | 1-1608 |
| 637 | pk331GM 59746258 | Glycine max | Chlorophyll a oxygenase (CAO)/chlorophyll b synthase | 44-1633 |
| 629 | pk331OS 37109650 | Oryza sativa | Chlorophyll a oxygenase (CAO)/chlorophyll b synthase | 82-1704 |
| 657 | pk320AT 01 | Arabidopsis thaliana | Hexokinase-like protein | 31-1509 |
| 681 | pk320BN 51431102 | Brassica napus | Hexokinase-like protein | 123-1625 |
| 659 | pk320GM59682267 | Glycine max | Hexokinase-like protein | 179-1666 |
| 778 | pk316BN 44215842 | Brassica napus | Pyruvate kinase | 100-1812 |

Those skilled in the art will recognize, or will be able to ascertain using no more than routine experimentation, many equivalents to the specific embodiments of the invention described herein. Such equivalents are intended to be encompassed by the claims to the invention disclosed and claimed herein.

SEQUENCE LISTING (824 sequences)

SEQ ID NO: 1 - DNA, 2571 bp, Arabidopsis thaliana
  CDS (1)..(2571)
atggtgtcaagatcttgtgctaattttctagacttatcatcttgggaccttttagattttcctcaaactccacgaactcttccacgcgtcatgactgttccgggaatcatcaccgacgtagacggtgatacaacctccgaagtaacttctacctccggtggttcacgtgagaggaagatcattgtagctaacatgttaccactccaatctaaaagagatgcagaaactggtaaatggtgttttaactgggacgaagactctctccagttacaacttagagatgggttctcttcagaaacagagtttctctacgttggatcacttaacgtagacatcgaaactaacgaacaagaagaagtttcacagaagcttttagaggaatttaactgcgttgcaacgtttttgtctcaagagttgcaagaaatgttctatcttggtttctgtaaacatcagttatggccactctttcattacatgcttccaatgtttcctgatcatggtgatcgttttgatcgacgtctatggcaagcttatgtatcagccaacaagatattttcagatagagttatggaagttatcaaccctgaggatgattacgtttggattcaagattatcatcttatggttcttcctactttcttgaggaaacgttttaataggatcaaactcggtttcttccttcatagtccgtttccttcttcagagatttaccgcacattgcctgttcgtgacgagattttgagaggtttgttgaattgtgatctcattggtttccatacgtttgattacgcgaggcatttcttgtcttgttgtagtagaatgcttggtcttgattacgagtctaagcgcggtcacataggtcttgattactttggtaggactgtgtatatcaaaatacttcctgttggtgttcatatgggtagattggagtctgttttgagtcttgattctactgcggcgaagacgaaagagattcaagaacagtttaaagggaagaagcttgttcttggtatcgatgatatggatatatttaaagggataagcttaaagcttatagcaatggaacatctctttgagacttattggcatttgaaagggaaagttgttcttgttcagatagtgaaccctgcaagatcttctggtaaagatgttgaagaagcgaagagggagacgtatgagactgcgaggaggatcaatgagcgttacggtacttctgactataagccgatagttttgatcgatcgtcttgttccacgttctgagaaaaccgcgtattatgctgcagcagattgttgcttagtgaatgcagtgagagatggtatgaacttagttccttataagtatatcgtctgcaggcaggggactcgaagtaataaggccgttgtggattcatcgcctcgcacaagcactcttgtcgtgtctgagtttattggatgctcaccttctttgagtggtgccattagggtgaatccatgggatgtggatgctgttgctgaagcggtaaactcggctcttaaaatgagtgagactgagaagcaactacggcatgagaaacattatcattatattagcactcatgatgttggttattgggcaaagagctttatgcaggatcttgagagagcgtgccgagatcattatagtaaacgttgttgggggattggttttggtttggggttcagagttttgtcactctctccaagttttaggaagctatctgtggaacacattgttccagtttatagaaaaacacagagaagagctatatttcttgattatgatggtactcttgttcctgaaagctccattgttcaagatccaagcaacgaggttgtctctgttctgaaagctctctgtgaagatccgaataacacggtgtttattgttagtggaagaggtagagagtctctgagcaattggctatctccttgtgaaaatcttggaatagcagctgaacatggatacttcattagatggaagagcaaagatgagtgggagacttgttattcgcctacggatacagagtggaggtcaatggtggaaccggttatgagatcgtatatggaggcaacagatgggacgagtatagagtttaaagaaagtgctttggtgtggcaccatcaagacgcagatcctgactttggatcatgtcaagctaaggagatgcttgatcatctagagagtgttctcgccaatgagcctgtggttgtcaagagaggtcaacacatcgttgaagtcaaaccacaaggtgtaagcaaaggtctagctgcggagaaagtaatccgagaaatggtagaacgcggggagccaccggaaatggtgatgtgcataggagacgatagatcagacgaagacatgtttgagagcatattaagcacagtgacaaatccggaacttcttgtgcagccagaggtttttgcatgcacggttggaagaaaaccaagcaaagctaaatacttcttggacgatgaagccgacgtgcttaagctcctaagaggtcttggagactcatcatcgagcttaaaacctagttcttctcacacacaagttgcatttgaaagcatcgtttaa

SEQ ID NO: 2 - protein, 856 aa, Arabidopsis thaliana
MVSRSCANFLDLSSWDLLDFPQTPRTLPRVMTVPGIITDVDGDTTSEVTSTSGGSRERKIIVANMLPLQSKRDAETGKWCFNWDEDSLQLQLRDGFSSETEFLYVGSLNVDIETNEQEEVSQKLLEEFNCVATFLSQELQEMFYLGFCKHQLWPLFHYMLPMFPDHGDRFDRRLWQAYVSANKIFSDRVMEVINPEDDYVWIQDYHLMVLPTFLRKRFNRIKLGFFLHSPFPSSEIYRTLPVRDEILRGLLNCDLIGFHTFDYARHFLSCCSRMLGLDYESKRGHIGLDYFGRTVYIKILPVGVHMGRLESVLSLDSTAAKTKEIQEQFKGKKLVLGIDDMDIFKGISLKLIAMEHLFETYWHLKGKVVLVQIVNPARSSGKDVEEAKRETYETARRINERYGTSDYKPIVLIDRLVPRSEKTAYYAAADCCLVNAVRDGMNLVPYKYIVCRQGTRSNKAVVDSSPRTSTLVVSEFIGCSPSLSGAIRVNPWDVDAVAEAVNSALKMSETEKQLRHEKHYHYISTHDVGYWAKSFMQDLERACRDHYSKRCWGIGFGLGFRVLSLSPSFRKLSVEHIVPVYRKTQRRAIFLDYDGTLVPESSIVQDPSNEVVSVLKALCEDPNNTVFIVSGRGRESLSNWLSPCENLGIAAEHGYFIRWKSKDEWETCYSPTDTEWRSMVEPVMRSYMEATDGTSIEFKESALVWHHQDADPDFGSCQAKEMLDHLESVLANEPVVVKRGQHIVEVKPQGVSKGLAAEKVIREMVERGEPPEMVMCIGDDRSDEDMFESILSTVTNPELLVQPEVFACTVGRKPSKAKYFLDDEADVLKLLRGLGDSSSSLKPSSSHTQVAFESIV

SEQ ID NO: 3 - DNA, 3134 bp, Zea mays
  CDS (124)..(2730)
  misc_feature (3116)..(3116): n is a, g, c or t
  misc_feature (3117)..(3117): n is a, g, c or t
cgattcggcacgacgtatattatgaggttccagactaatgcatcatcttcccaaactagcccttacaggaatttattttgtacaggcctcaacgagctagcctgagacaagaacactggaaccatggtttcaaaatcatattcaaatctgctagacatgaccccaggagatgggtttgactttcgacgaccttttaagtctcttcctcgtgttgtaacttctcctagcattatatctgaccatgattgggattccataagtgatggtgattcagttggttcagcattttctatcgagaggaaaataattgtcgccaacttccttccgctgaattgtacaagagatgaaaccggggaactgtccttctcattggatcatgattcactactcatgcaacttaaagatgggttttcaaatgagactgatgctgtgtatgtaggcagtttgaaggttcatgtagatcccagggagcaggaccaagttgcacagaagcttctcagagaatatcgatgcatacctacttttctcccatctgatctgcagcagcagttctatcatggcttctgtaaacaacagttatggccactttttcattatatgcttccaatttgccttgacaagggtgagttgtttgatcgcaccctgtttcaagcctatgtccgagccaacaaactttttgcagataaagttatggaagcaatcaatacagatgatgattatgtttgggttcatgattatcatctcatgctgctccctacattcttgaggaagaggttacaccgaataaagattggtttcttccttcacagcccttttccctcttcagaaatatacaggactctgcctgtaagggatgaaatcctgaagtcactgcttaatgctgatctgattggtttccaaacatttgactatgcccgccacttcctatcttgctgtagcagattgctaggcctgcattatgagtcaaaacgtggttacattggaatagagtattttggccgaacagtgagtttgaagatcctttctgtgggtgtccatgttggtcggcttgaatctgtcttaaagttgcctgctacagttagtaaggttgaagaaattgaacaaaggtataagggcaagatactcatgttaggtgtagatgacatggacatcttcaaaggaataagtctgaaattgcttgcactggagcttcttctggacagaaacccaaagcttagagagaaggttgtccttgtacagatcatcaatcccgcaagaagcacggggaaggatgtgcaggaagctatcacagaagctgtctctgtggctgaaagggttaacacaaagtatggttcttcaagttacaagcctgtcgtcctaattgataatcgcataccgttttatgaaaaggttgcattctatgccgcgtctgactgttgtattgtaaacgctgtgagggatggcatgaacttagtaccatatgagtatactgtttgccgacagggaaacgaggagatcgacagagtcagaggccttgacaaagacacccatcacacaagcacacttattgtttcggagtttgtgggttgctccccatctctgagtggtgctttcagggtaaatccttggagcgtcgatgatgtggcggatgccttgtgccgcgcaactgatctatctgaatctgagaaacggttgcggcacgaaaagcattatcgctatgtcagtactcatgatgttgcttactgggcgcacagctttgctcaagatctggaaagagcatgcagagaccattacagccgaaggtgttgggctattgggtttggcctgaatttcagagtcattgctctttctcctggcttcagaaagctttcttcggagcactttgtttcttcttataacagggcttctagaagggcaatatttctcgactacgacggcacacttgtgccccagtcgtcaatcaacaaggctccaagtgaagaagtcatctccattcttaacaccttgtgtaatgatccaaagaacgttgtgtttatcgtaagtggacgaggacgtgattccctcgacgagtggttttctccatgcgagaagctccgtctagccgcagaacatggctattttatcaggtggagcaaggaagctgcatgggagtcgagctattcgagtccgcggcaagaatggaagcacatcgctgaacctgtcatgcaggtatacaccgagacaacagacggatcttcagtcgagtcgaaggagagcgctctagtgtggcactatttggatgcagaccatgatttcggttccttccaagcgaaggagctaaaggatcatcttgagagggtgctatcaaatgagcccgttgttgtgaagtgtggccattatatcgtagaagtaaagccgcagggagttagcaagggtcgtgctgtcgacaagctgattcaagcactggccaacaacaacgggaaggcacaggatttcctgatgtgcgtcggcaacgacagatctgacgaggacatgttcgaatgcatcaacggtatggcctccaacgatgtctcatcgaccacagtaccggaggtgtttgcctgttcggtcggccagaagcccagcaaagcaaaatactatgtggacgacaccagcgaagtgatcagattgctcagggatgcaacccgcttctcatcgtcgcagcggagggaggacgtcaacgccagccgcgggcgtgtgaccttcagagacgcactcgattacgtggactaggcaccagcagcaattcttagttactcgaaatgattagctgcggagcttgtaaattccgctgtcttctgtctgccaatggttttcgttctagagaattgtagtgtagccgacatcgacatggatcgtcgtcaccgatacacgaacagcggaaatatgagttgaagttcgccgtttcgaggctcagaattggtacatttatagaattgtagtgtaggcaattttttggtagggaatagtaattggtacatttatagaattgtcaattgtttttcttctaccgctgataatactatagcttcgctaaattaatattattgtttcacttagcgatgaaaaaaaaaaaaaaaaaaaaaaaaaaaaaaaaaaaaaaaaaaaaaaaaaaaaanncaaaaaaaaaaaaaaaa

SEQ ID NO: 4 - protein, 868 aa, Zea mays
MVSKSYSNLLDMTPGDGFDFRRPFKSLPRVVTSPSIISDHDWDSISDGDSVGSAFSIERKIIVANFLPLNCTRDETGELSFSLDHDSLLMQLKDGFSNETDAVYVGSLKVHVDPREQDQVAQKLLREYRCIPTFLPSDLQQQFYHGFCKQQLWPLFHYMLPICLDKGELFDRTLFQAYVRANKLFADKVMEAINTDDDYVWVHDYHLMLLPTFLRKRLHRIKIGFFLHSPFPSSEIYRTLPVRDEILKSLLNADLIGFQTFDYARHFLSCCSRLLGLHYESKRGYIGIEYFGRTVSLKILSVGVHVGRLESVLKLPATVSKVEEIEQRYKGKILMLGVDDMDIFKGISLKLLALELLLDRNPKLREKVVLVQIINPARSTGKDVQEAITEAVSVAERVNTKYGSSSYKPVVLIDNRIPFYEKVAFYAASDCCIVNAVRDGMNLVPYEYTVCRQGNEEIDRVRGLDKDTHHTSTLIVSEFVGCSPSLSGAFRVNPWSVDDVADALCRATDLSESEKRLRHEKHYRYVSTHDVAYWAHSFAQDLERACRDHYSRRCWAIGFGLNFRVIALSPGFRKLSSEHFVSSYNRASRRAIFLDYDGTLVPQSSINKAPSEEVISILNTLCNDPKNVVFIVSGRGRDSLDEWFSPCEKLRLAAEHGYFIRWSKEAAWESSYSSPRQEWKHIAEPVMQVYTETTDGSSVESKESALVWHYLDADHDFGSFQAKELKDHLERVLSNEPVVVKCGHYIVEVKPQGVSKGRAVDKLIQALANNNGKAQDFLMCVGNDRSDEDMFECINGMASNDVSSTTVPEVFACSVGQKPSKAKYYVDDTSEVIRLLRDATRFSSSQRREDVNASRGRVTFRDALDYVD

SEQ ID NO: 5 - DNA, 2556 bp, Arabidopsis thaliana
  CDS (1)..(2556)
atgatttctaggtcgtacacgaatctgttagacttggcatcagggaatttccctgtcatgggaagagagcgtaggcggcttcctagggtaatgactgttcctggtaatgtctctgagtttgatgaagatcaagcgtatagtgtgtcttccgataatccttcttcggtttcctctgatcgaatgatcattgtggctaaccggctcccattgaaggcggagaaacgaaatggaagctggagttttagttgggatcaagattctctgtatttgcagctcaaggacgggttgcctgaggatatggagattttatatgttggatctttgagcgttgatgttgattcaaatgaacaagacgatgtggcgcagatactgttggacaaatttaaatgtgttcctacgtttttcccacctgatttgcaatcaaagttttacgacggtttttgcaagaggcagatatggccgctttttcactacatgcttccgttttccgctgatcatggtggaagatttgataggtctctttgggaggcttatgtagcgactaacaagctcttcttccagaaagtaattgaggttattaacccagatgatgattttgtctggattcatgactaccatttgatggtcttaccaacttttctgagaaggcggtttaaccggataaggatgggatttttccttcacagtcccttcccctcatctgagatataccggtctcttcctgttcgggaggagatacttaaggcgttactaaacagcgaccttattggctttcacacgttcgattatgctcgtcacttccttacttgctgcagtcggatgttgggtctagaatatcagtctaagagaggttacattgggctggagtattacgggaggactgtgggaatcaagatcatgccagtggggatcaacatgggtcggattcaatcggtgatgagatattcagaagaggagggtaaggtgatggagctcagaaatcgtttcgaaggtaagacagtgttgcttggtatcgatgacatggatattttcaagggtataaacctgaagcttctagcaatggaacaaatgctgaggcagcacccgaattggaggggaagggctgttctggttcagattgtaaatcccgctaggggtaaaggtattgatgtagaggaaatacgtggtgaaatcgaagaaagctgcaggaggatcaatggagagtttgggaaacctggatatcaacctatcatatatattgatactccggtttcgattaatgaaataaatgcttattaccatattgctgagtgcgtggtcgttacagctgttagagatggtatgaaccttactccctacgaatatatcgtttgtagacaaggtttacttgggtctgaatcagactttagtggcccaaagaagagcatgttggttgcatcagagtttattggatgttccccttcgcttagtggggctatacgcgtaaacccatggaacgttgaagctactggagaagcactaaatgaggccctctcaatgagtgatgctgagaaacagctacggcatgagaaacatttccggtatgttagtactcacgatgtagcttattggtcaagaagtttcttgcaagacctagagaggatatgtgtggaccatttcaagaaaaggtgttgggggatggggattagttttggtttcagagttgttgcactcgatcctaattttagaaagctttcaataccgtgcattgtgtcagactacaaaagggcgaaaagcagagcgatactgttggattatgatggcactctgatgcctcaaaactccatcaataaagctccaagccaggaagttcttaactttttggatgcactttgcgaggacaagaagaattcaattttcattgtcagtggaagagggagggaaagtttaagcaagtggttcactccgtgcaaaaaaattggaattgcggcagagcatggatacttcttaaagtggtcaggcagtgaagaatgggagacatgtgggcagagctctgattttgggtggatgcagatcgtggaacctgtaatgaagcagtacactgaatcgactgatggctcttccattgaaatcaaagagagcgctttggtttggcaatatcgggatgcagatccaggctttggttctttacaagcgaaggaaatgctagagcatttagagagtgttctagctaatgagccagtggcagtcaaaagcggtcactacatagtagaagtcaagcctcagggagtgagcaaaggatccgtgtcagaaaagatattttcatcaatggccggaaagggaaaaccggttgatttcgtgttatgtattggagatgacagatctgatgaagacatgtttgaagcgattggtaatgcgatgtcgaaaaggttactctgtgataatgctctagtctttgcatgcacagttgggcaaaagccaagcaaggctaaatactacttggacgatactactgaagtgacatgcatgcttgaatctctagctgaagcatcagaggcttcaaacttttctatgcgtgaacttgatgaagccctttga

SEQ ID NO: 6 - protein, 851 aa, Arabidopsis thaliana
MISRSYTNLLDLASGNFPVMGRERRRLPRVMTVPGNVSEFDEDQAYSVSSDNPSSVSSDRMIIVANRLPLKAEKRNGSWSFSWDQDSLYLQLKDGLPEDMEILYVGSLSVDVDSNEQDDVAQILLDKFKCVPTFFPPDLQSKFYDGFCKRQIWPLFHYMLPFSADHGGRFDRSLWEAYVATNKLFFQKVIEVINPDDDFVWIHDYHLMVLPTFLRRRFNRIRMGFFLHSPFPSSEIYRSLPVREEILKALLNSDLIGFHTFDYARHFLTCCSRMLGLEYQSKRGYIGLEYYGRTVGIKIMPVGINMGRIQSVMRYSEEEGKVMELRNRFEGKTVLLGIDDMDIFKGINLKLLAMEQMLRQHPNWRGRAVLVQIVNPARGKGIDVEEIRGEIEESCRRINGEFGKPGYQPIIYIDTPVSINEINAYYHIAECVVVTAVRDGMNLTPYEYIVCRQGLLGSESDFSGPKKSMLVASEFIGCSPSLSGAIRVNPWNVEATGEALNEALSMSDAEKQLRHEKHFRYVSTHDVAYWSRSFLQDLERICVDHFKKRCWGMGISFGFRVVALDPNFRKLSIPCIVSDYKRAKSRAILLDYDGTLMPQNSINKAPSQEVLNFLDALCEDKKNSIFIVSGRGRESLSKWFTPCKKIGIAAEHGYFLKWSGSEEWETCGQSSDFGWMQIVEPVMKQYTESTDGSSIEIKESALVWQYRDADPGFGSLQAKEMLEHLESVLANEPVAVKSGHYIVEVKPQGVSKGSVSEKIFSSMAGKGKPVDFVLCIGDDRSDEDMFEAIGNAMSKRLLCDNALVFACTVGQKPSKAKYYLDDTTEVTCMLESLAEASEASNFSMRELDEAL

SEQ ID NO: 7 - DNA, 2604 bp, Arabidopsis thaliana
  CDS (1)..(2604)
atggtgtcaagatcttgtgcaaattttctagatttagcatcttgggacttattggactttcctcaaactcaaagagctcttcctcgtgtcatgactgttcctggtatcatctctgagttggatggaggctacagtgatggatcctctgatgttaattcctcaaacagctcccgtgagcggaagattatagtggctaatatgttaccattacaagctaagagagatacagaaactggacaatggtgttttagttgggatgaagattctcttctcttgcaactcagagatgggttttcttcggatacagagtttgtttatataggatcacttaatgctgatattggtattagtgaacaagaagaagtttctcataagcttttgttggatttcaattgtgttcctacgtttttacccaaggagatgcaagagaagttctatcttggtttctgtaaacatcatttgtggccgctatttcactatatgcttcctatgttccctgaccatggtgatcgttttgaccggcgtctttggcaagcgtatgtctctgcaaacaagatattttcagatagggtgatggaagttatcaaccctgaggaagattatgtttggattcatgattatcatctgatggttcttcccacattcttgaggaaacggtttaacaggatcaagcttggatttttccttcacagtccatttccatcatcagaaatttaccgtactttgccagtccgggatgatcttttgagaggattgttgaactgtgatctcattggcttccacacatttgattatgcacgccattttttgtcatgctgcagtagaatgcttgggcttgattatgaatctaagcgtgggcacatcgggcttgattactttggtcgaacggtgtttattaagatccttcctgttggcatccatatggggaggctggaatcggttttgaatcttccgtcgactgcagcgaaaatgaaagagatacaagaacagtttaaggggaaaaagttgattcttggtgttgacgacatggacatctttaaaggcataagcctcaaacttatagccatggaacgtctctttgagacatattggcatatgcgaggaaaacttgtcctgattcagatagtgaacccagcacgggccacgggtaaggatgtggaagaagcaaagaaggagacatattcaactgcaaaaaggatcaatgagcgctatggttctgctggttatcagccagtgatcttgattgatcgtcttgttcctcgttacgagaagactgcttattatgctatggcagactgctgcctggtgaatgcagtaagagacggcatgaacttagttccatataaatatatcatttgcaggcaagggaccccaggaatggataaggccatggggattagccatgactcagcccggacgagcatgcttgttgtctctgagtttatcggctgctcgccttctttgagtggtgcgatcagggtgaacccatgggatgtagatgctgttgcagaagcggtaaacttagccctcactatgggtgagactgaaaagcgattaaggcacgagaaacactatcactatgtgagtactcatgatgtgggttactgggcaaagagctttatgcaggatcttgagagggcatgccgggagcattataataaacgttgttggggtattggttttggcttgagtttcagagttctgtcactgtctccgagttttaggaagctatctatcgatcacattgtctccacgtatagaaatacacagagaagggcaatatttttggactatgatggcactctcgttcctgaaagctccatcatcaaaacccctaatgccgaagtcctgtctgttctgaaatctctgtgtggagatcctaaaaacactgtgtttgttgtcagtggaagaggatgggagtctctgagcgactggctatctccatgtgaaaatcttggaatcgcagctgaacacggatacttcataaggtggagtagcaagaaagaatgggagacttgttattcgtcggctgaggcggaatggaagacgatggtagaaccggtaatgagatcatacatggacgcaaccgatggttctactatagagtacaaagagagtgctttggtttggcatcatcaagacgcagatccagactttggagcctgtcaagcaaaagagcttctagatcatctagagagtgtactcgcaaatgagcctgtagtcgtcaagagaggccaacacattgtagaggtcaaaccacagggagtaagcaaaggtctagcagtggaaaaggtgatacaccaaatggtagaggatggaaacccaccggacatggtgatgtgtataggagatgacagatcagacgaagacatgtttgagagcatattgagcacagtgacaaacccggacctcccaatgccacctgagatctttgcctgcacggtgggaagaaaaccaagcaaagccaaatacttcttagacgatgtctctgatgtattaaagctcctaggaggattagctgctgcaacgagcagctcgaagccagagtatcaacaacaatcctcctcattgcacacgcaagtggcgtttgagagcatcatatga

SEQ ID NO: 8 - protein, 867 aa, Arabidopsis thaliana
MVSRSCANFLDLASWDLLDFPQTQRALPRVMTVPGIISELDGGYSDGSSDVNSSNSSRERKIIVANMLPLQAKRDTETGQWCFSWDEDSLLLQLRDGFSSDTEFVYIGSLNADIGISEQEEVSHKLLLDFNCVPTFLPKEMQEKFYLGFCKHHLWPLFHYMLPMFPDHGDRFDRRLWQAYVSANKIFSDRVMEVINPEEDYVWIHDYHLMVLPTFLRKRFNRIKLGFFLHSPFPSSEIYRTLPVRDDLLRGLLNCDLIGFHTFDYARHFLSCCSRMLGLDYESKRGHIGLDYFGRTVFIKILPVGIHMGRLESVLNLPSTAAKMKEIQEQFKGKKLILGVDDMDIFKGISLKLIAMERLFETYWHMRGKLVLIQIVNPARATGKDVEEAKKETYSTAKRINERYGSAGYQPVILIDRLVPRYEKTAYYAMADCCLVNAVRDGMNLVPYKYIICRQGTPGMDKAMGISHDSARTSMLVVSEFIGCSPSLSGAIRVNPWDVDAVAEAVNLALTMGETEKRLRHEKHYHYVSTHDVGYWAKSFMQDLERACREHYNKRCWGIGFGLSFRVLSLSPSFRKLSIDHIVSTYRNTQRRAIFLDYDGTLVPESSIIKTPNAEVLSVLKSLCGDPKNTVFVVSGRGWESLSDWLSPCENLGIAAEHGYFIRWSSKKEWETCYSSAEAEWKTMVEPVMRSYMDATDGSTIEYKESALVWHHQDADPDFGACQAKELLDHLESVLANEPVVVKRGQHIVEVKPQGVSKGLAVEKVIHQMVEDGNPPDMVMCIGDDRSDEDMFESILSTVTNPDLPMPPEIFACTVGRKPSKAKYFLDDVSDVLKLLGGLAAATSSSKPEYQQQSSSLHTQVAFESII

SEQ ID NO: 9 - DNA, 2586 bp, Arabidopsis thaliana
  CDS (1)..(2586)
atggggtcaaaatcatttggaaatctattagacttggcctctggggatcttttggacattcctcagactccgagatatcttccaagagtgatgactgttcctggcattatctctgacgttgatggatatggaattagtgatggcgattcagatgtcatttcattaccttgccgtgagcggaaaatcattgtggccaattttcttcctttgaatggtaaaaaggattcagaaactggaaagtggaaattcagtctcgacaatgattctcccctgttacatctcaaggatggtttttctccagagactgaagtcatttatgttggatcgctcaagacgcatgttgatgttagtgagcaagacgaggtttcccataatctttttgaggaattcaattgtgtagcgactttcctcccacaagatgtgcataaaaaattctaccttggcttttgtaaacagcaactatggccacttttccattacatgttacccatgtgtcctgatcatggtgaacggtttgatcgtggtctttggcaggcatatgtttctgccaacaagatatttgcagataaggtaatgggtgtgattaatcttgaagaagattatatctggattcatgactatcatttaatggttctcccaacatttttgagaaggcggtttcacagggttaagcttggtttcttcctccacagtccattcccttcttcagaaatttatcgaaccttacctgttcgagaggaactactaagagggctcttaaattgtgacttaattggttttcacacgtttgattatgcacggcatttcttgtcatgctgctgtagaatgcttggattggagtatgaatctaagagagggcatattgctcttgactacttgggacgtacagtttttctgaagattcttcctataggtattcacatgggaaggctggaatccgttctgaatcttcctgctacagctgaaaagctgaaagagattcaagaaaagtatcggggtaaaaagataattctcggtgttgatgacatggatatattcaaaggtttaagtcttaaaattttggcctttgaacacctccttcagcaatatcctagcatgctagggaaaatagttcttattcagattgtgaacccagccagaggctcaggtaaagacgttcaggaagcgaggaaagaaacgtatgatactgttaaaagaatcaacgagcgttatggttcacatgattatgagccagtggttctgattgatcgccctgttcctcggtttgagaagtctgcctattatgccctggcagaatgctgcatagtcaatgcagtgagggatgggatgaacttagttccgtacaagtacactgtttgtcggcagggaactcctagtatgaataagtctttgggagtaagtgatgatttgcctcgcacaagcacccttgttctgtccgagttcattggttgctcgccttctctaagtggtgcgattagggttaatccttgggacgttgacgcggtagccgattcactatattctgctattaccatgtctgattttgagaagcaactacgacataaaaaacactttcactacattagtacacatgatgtgggttattgggcgcgcagcttttcgcaggatttggagagggcatctcgagatcattacagtaaacggtgctggggtgtgggttggggtttgggtttcaggcttgtcgctctctctcctaatttcagaaggctatccattgagcaaactgttagtgcttacagaagatcgagcaagagagcaatatttcttgattatgatggtactttagttcctgagacctcgattgtaaaggacccaagtgctgaagttatatctgcgttgaaggcactgtgtagtgatcctaacaacactatatttattgttagcgggaggggaaaagtttctttgagcgagtggcttgcgccatgtgagaatcttggaatagcggctgaacatggttactttacaaggtggaataagtcttctgactgggaaacaagcggcttatctgatgaccttgagtggaagaaagttgtggaacctattatgagactttatacagagactactgatggatccaatatagaagcaaaagagagtgctttagtctggcatcaccaagatgctgacccagactttggttcttgtcaagccaaggaactactggaccatctagaaactgttcttgtgaatgaaccagttattgtgaacagaggccaccaaatcgttgaagttaagcctcagggagtaagcaaagggcttgtcaccgggaaaattcttagccgaatgcttgaagatgggatagcgccagattttgtggtatgcattggggatgatagatcagacgaggagatgtttgaaaacatatcaacaaccctctcagctcaatcatcgtcaatgtctacagagatattcgcgtgtactgtgggaagaaaaccgagcaaagccaaatacttcctcgatgaagtaagcgacgtggtgaagttgcttcaaggacttgccaacacttcgagcccaaagcctaggtacccttctcacctcagagtctccttcgaaagcgtggtatga

SEQ ID NO: 10 - protein, 861 aa, Arabidopsis thaliana
MGSKSFGNLLDLASGDLLDIPQTPRYLPRVMTVPGIISDVDGYGISDGDSDVISLPCRERKIIVANFLPLNGKKDSETGKWKFSLDNDSPLLHLKDGFSPETEVIYVGSLKTHVDVSEQDEVSHNLFEEFNCVATFLPQDVHKKFYLGFCKQQLWPLFHYMLPMCPDHGERFDRGLWQAYVSANKIFADKVMGVINLEEDYIWIHDYHLMVLPTFLRRRFHRVKLGFFLHSPFPSSEIYRTLPVREELLRGLLNCDLIGFHTFDYARHFLSCCCRMLGLEYESKRGHIALDYLGRTVFLKILPIGIHMGRLESVLNLPATAEKLKEIQEKYRGKKIILGVDDMDIFKGLSLKILAFEHLLQQYPSMLGKIVLIQIVNPARGSGKDVQEARKETYDTVKRINERYGSHDYEPVVLIDRPVPRFEKSAYYALAECCIVNAVRDGMNLVPYKYTVCRQGTPSMNKSLGVSDDLPRTSTLVLSEFIGCSPSLSGAIRVNPWDVDAVADSLYSAITMSDFEKQLRHKKHFHYISTHDVGYWARSFSQDLERASRDHYSKRCWGVGWGLGFRLVALSPNFRRLSIEQTVSAYRRSSKRAIFLDYDGTLVPETSIVKDPSAEVISALKALCSDPNNTIFIVSGRGKVSLSEWLAPCENLGIAAEHGYFTRWNKSSDWETSGLSDDLEWKKVVEPIMRLYTETTDGSNIEAKESALVWHHQDADPDFGSCQAKELLDHLETVLVNEPVIVNRGHQIVEVKPQGVSKGLVTGKILSRMLEDGIAPDFVVCIGDDRSDEEMFENISTTLSAQSSSMSTEIFACTVGRKPSKAKYFLDEVSDVVKLLQGLANTSSPKPRYPSHLRVSFESVV

SEQ ID NO: 11 - DNA, 2589 bp, Arabidopsis thaliana
  CDS (1)..(2589)
atgtcgccggaatcttggaaagaccagcttagtctggtttcggctgatgattatcggatcatgggtcgaaatcggatccccaatgccgtcacgaagctttccggtctcgaaaccgacgatcctaacggcggcgcgtgggttacgaaaccgaaacgaatcgtggtttcgaatcagcttcctcttcgtgctcacagagacatttcgtcgaacaagtggtgctttgaattcgacaatgacagtctttacttacaactcaaagatgggtttcctccggagacggaagtcgtctacgtcggatctttaaacgccgacgtcttaccttcagagcaagaggacgtctctcagttcttgcttgagaagtttcagtgtgttcctactttcttacctagtgacttgctcaacaagtattaccatggtttctgtaaacactatctctggcccatttttcactatcttcttcctatgacgcaagctcaaggctctctctttgatcgttcgaattggagagcgtacacgactgttaacaagatcttcgctgataagatcttcgaagtgctaaacccggatgatgattacgtctggattcatgattatcacctcatgattttgcccacttttttgaggaacaggtttcatcggataaagcttgggattttcctccatagtccctttccttcgtcggagatttaccgtactcttcctgtgagagacgagattctcaaagggtttctgaattgcgatttggttggtttccacacgtttgattacgctaggcatttcttgtcttgttgtagtaggatgcttggtcttgattacgaatctaaaagaggctacattggtcttgaatattttggaagaacggtgagcatcaagatattgcccgttgggattcatatggggcagattgaatcgataaaggcttcggagaaaactgcagagaaagtgaagagattgagagaaaggttcaaggggaacattgtgatgttaggtgtggatgatttggatatgttcaaaggtattagcttgaagttttgggcgatgggtcagcttcttgaacagaacgaagagcttcgtgggaaagtggttctcgtgcagattactaatcctgctcgtagttcaggtaaggatgttcaagatgtagagaaacagataaatttgattgctgatgagatcaattctaaatttgggagacctggtggttataagcctattgtgtttatcaatggacctgttagtactttggataaagttgcttattacgcgatctcggagtgtgttgtcgtgaatgctgtgagagatgggatgaatttggtgccttataagtacacagtgactcggcaagggagccctgctttggatgcagctttaggttttggggaggatgatgttaggaagagtgtgattattgtttctgagttcatcggttgttctccatctctgagtggtgcgatccgtgttaatccgtggaacatcgatgcagtcactaacgccatgagctctgcaatgacgatgtccgacaaagagaaaaatctgcgccaccagaagcatcataagtacataagctctcacaatgttgcctattgggcgcggagttatgaccaagatcttcaaagggcgtgcaaagatcattacaacaagagattctggggagtcggattcggtctttttttcaaggttgttgcgttagatccgaatttcagaaggctctgtggtgaaaccatagtccccgcgtataggagatcaagcagtaggttgatcctattggactatgatgggacaatgatggatcaggatactctggataaaaggccaagtgatgatcttatctcgcttctcaatcgcttatgtgacgaccccagcaatctagtctttattgttagtggtcgaggtaaggaccctctcagcaaatggtttgactcttgcccaaatcttggtatctcagctgaacatggttatttcactagatggaactcaaattccccttgggaaacaagtgaattgcctgcggatttaagctggaagaaaatagctaaaccagtgatgaatcactatatggaagcgactgatggatcattcatagaggagaaagagagtgctatggtgtggcaccaccaagaagctgaccattcatttggttcttggcaagctaaggagcttcttgatcatctagagagtgttctcaccaatgagcctgttgttgtcaagagaggccagcacatagtagaagttaaacctcagggagtaagcaaaggaaaggtggtggagcatttgatagcaacgatgaggaacaccaaagggaagagaccggactttttgttgtgcataggtgatgaccggtctgatgaagacatgtttgatagcatagtgaagcaccaagatgtttcctctattggtctcgaagaggtctttgcgtgcacagttggtcagaaaccgagcaaggccaagtactatctcgatgataccccaagtgttatcaagatgcttgaatggttggcctcagcttcagatggatcaaagcatgagcaacagaagaaacagagcaagttcacttttcaacagcctatgggacaatgtcgaaagaaagcatag

SEQ ID NO: 12 - protein, 862 aa, Arabidopsis thaliana
MSPESWKDQLSLVSADDYRIMGRNRIPNAVTKLSGLETDDPNGGAWVTKPKRIVVSNQLPLRAHRDISSNKWCFEFDNDSLYLQLKDGFPPETEVVYVGSLNADVLPSEQEDVSQFLLEKFQCVPTFLPSDLLNKYYHGFCKHYLWPIFHYLLPMTQAQGSLFDRSNWRAYTTVNKIFADKIFEVLNPDDDYVWIHDYHLMILPTFLRNRFHRIKLGIFLHSPFPSSEIYRTLPVRDEILKGFLNCDLVGFHTFDYARHFLSCCSRMLGLDYESKRGYIGLEYFGRTVSIKILPVGIHMGQIESIKASEKTAEKVKRLRERFKGNIVMLGVDDLDMFKGISLKFWAMGQLLEQNEELRGKVVLVQITNPARSSGKDVQDVEKQINLIADEINSKFGRPGGYKPIVFINGPVSTLDKVAYYAISECVVVNAVRDGMNLVPYKYTVTRQGSPALDAALGFGEDDVRKSVIIVSEFIGCSPSLSGAIRVNPWNIDAVTNAMSSAMTMSDKEKNLRHQKHHKYISSHNVAYWARSYDQDLQRACKDHYNKRFWGVGFGLFFKVVALDPNFRRLCGETIVPAYRRSSSRLILLDYDGTMMDQDTLDKRPSDDLISLLNRLCDDPSNLVFIVSGRGKDPLSKWFDSCPNLGISAEHGYFTRWNSNSPWETSELPADLSWKKIAKPVMNHYMEATDGSFIEEKESAMVWHHQEADHSFGSWQAKELLDHLESVLTNEPVVVKRGQHIVEVKPQGVSKGKVVEHLIATMRNTKGKRPDFLLCIGDDRSDEDMFDSIVKHQDVSSIGLEEVFACTVGQKPSKAKYYLDDTPSVIKMLEWLASASDGSKHEQQKKQSKFTFQQPMGQCRKKA

SEQ ID NO: 13 - DNA, 2589 bp, Arabidopsis thaliana
  CDS (1)..(2589)
atggtatcaagatcttattcaaacctcttggatcttgcttctggtaacttccattcgttttctcgagaaaagaagaggtttccaagagtagcaactgtcactggtgtcttatctgagctagatgatgataacaacagcaacagtgtctgctctgatgctccttcttccgtcacacaagatcgaatcatcatcgttggaaaccagcttcctattaaatcacatcggaactctgctggtaaattgagttttagttgggacaatgactcgcttctcttgcagcttaaagatggtatgcgtgaagatatggaagttgtctacattggttgccttaaggaacagattgatacagttgagcaagatgatgtttctcaaaggttgcttgagaatttcaaatgtgttcctgcttatatcccacctgagctattcactaagtactatcatggattctgtaagcaacatctatggcctttgtttcactacatgcttcccttaactcctgatcttggtggtagatttgatcgttctttatggcaagcttatctttcggttaacaagatctttgctgataaagtgatggaagtgattagtcctgatgatgattttgtttgggttcatgactatcacttaatggttttgcctacatttctaaggaagaggtttaatagagtaaagcttggttttttccttcatagcccgttcccttcctctgagatttaccgtactcttccagtgagaaatgagctcttacgtgcactcctcaacgctgatttgattggctttcatacctttgactatgcaagacacttcctttcttgttgtagcaggatgcttggtttatcctatcagtccaaacgtggaaccatagggcttgagtattatggtcgaacggttagtatcaagattcttcctgtggggattcatatcagccagcttcagtcaattttaaacctcccagagactcagaccaaagttgctgagctaagagatcagttcttggatcagaaagttcttctcggtgttgatgacatggacatcttcaaaggaatcagcctcaaactcttggcaatggaacaacttctcacacagcatcccgagaagagaggtcgagttgtacttgtccagattgcaaaccctgcaagaggtcgtgggaaagacgttcaggaggttcagtctgaaactgaagccacggttaaaaggatcaatgaaatgtttggaaggccgggctaccaacccgtggttctgattgatacaccgcttcaattctttgagaggattgcttactatgtcattgcagagtgttgtcttgttacagcggtaagagatggtatgaatcttataccttatgagtacattatctgcaggcaaggtaatccgaaactcaacgagactataggccttgacccttctgctgcaaagaagagtatgcttgttgtctctgagtttattggttgttctccttctttaagcggcgccattagagtaaatccgtggaacattgatgctgtgactgaagcaatggactatgcattgatagtttcagaagcagagaagcaaatgcgtcacgagaagcatcacaaatatgttagcacacatgatgttgcttattgggcgcgtagctttatacaagatcttgaaagggcttgcggggatcatgtgaggaagaggtgttgggggattggattcgggttaggctttagagttgtggcgcttgatccgagttttaaaaagctttcgattgagcacattgtctcagcttataagagaaccaagaaccgagccattttgttggattatgatggcacaatggtgcagccaggttccattaggacaacaccaacccgcgaaacaatcgaaatcttgaacaacctgtctagtgatcccaagaatatcgtgtacctcgtcagtgggaaagacagaaggacactaactgaatggttttcttcatgtgacgatctcggtttgggtgcagagcacgggtattttataaggccaaatgatggaacagactgggaaacgtcgagtttggtatcaggttttgagtggaaacaaatagcagagccagtgatgagactttacactgagactacagatggatcaacaatagagactaaagagactgctctcgtttggaattaccaattcgcagatcctgattttggatcttgtcaagccaaagagcttatggaacacctcgaaagcgtgcttaccaatgatccagtctctgtcaagactggacaacaactcgttgaagttaaaccacagggtgtgaacaaaggtcttgtggcagagaggcttctaacaacgatgcaagaaaaagggaaacttttggatttcattctctgcgtcggtgatgatcggtctgatgaggatatgtttgaggtgataatgagtgctaaagatggtccagctttgtctcctgtggctgagatattcgcttgcaccgttggacaaaagccaagcaaagcaaaatactatttagacgatactgcggagataatcagaatgctggacggtctagccgctaccaacacaactatctctgatcaaactgattcaaccgccactgttccaactaaagatctgttttaa

SEQ ID NO: 14 - protein, 862 aa, Arabidopsis thaliana
MVSRSYSNLLDLASGNFHSFSREKKRFPRVATVTGVLSELDDDNNSNSVCSDAPSSVTQDRIIIVGNQLPIKSHRNSAGKLSFSWDNDSLLLQLKDGMREDMEVVYIGCLKEQIDTVEQDDVSQRLLENFKCVPAYIPPELFTKYYHGFCKQHLWPLFHYMLPLTPDLGGRFDRSLWQAYLSVNKIFADKVMEVISPDDDFVWVHDYHLMVLPTFLRKRFNRVKLGFFLHSPFPSSEIYRTLPVRNELLRALLNADLIGFHTFDYARHFLSCCSRMLGLSYQSKRGTIGLEYYGRTVSIKILPVGIHISQLQSILNLPETQTKVAELRDQFLDQKVLLGVDDMDIFKGISLKLLAMEQLLTQHPEKRGRVVLVQIANPARGRGKDVQEVQSETEATVKRINEMFGRPGYQPVVLIDTPLQFFERIAYYVIAECCLVTAVRDGMNLIPYEYIICRQGNPKLNETIGLDPSAAKKSMLVVSEFIGCSPSLSGAIRVNPWNIDAVTEAMDYALIVSEAEKQMRHEKHHKYVSTHDVAYWARSFIQDLERACGDHVRKRCWGIGFGLGFRVVALDPSFKKLSIEHIVSAYKRTKNRAILLDYDGTMVQPGSIRTTPTRETIEILNNLSSDPKNIVYLVSGKDRRTLTEWFSSCDDLGLGAEHGYFIRPNDGTDWETSSLVSGFEWKQIAEPVMRLYTETTDGSTIETKETALVWNYQFADPDFGSCQAKELMEHLESVLTNDPVSVKTGQQLVEVKPQGVNKGLVAERLLTTMQEKGKLLDFILCVGDDRSDEDMFEVIMSAKDGPALSPVAEIFACTVGQKPSKAKYYLDDTAEIIRMLDGLAATNTTISDQTDSTATVPTKDLF

SEQ ID NO: 15 - DNA, 2583 bp, Oryza sativa
  CDS (1)..(2583): Japonica cultivar group
atggtttctcggtcctactccaacctgctggacctggccaccggcgcggcggaccaggcgccggcgccggcggcgctcggcgcgctccggcggcggctgccgcgggtggtgaccaccgcggggctcatcgacgactccccgctgtccccctcgacgccgtccccgtcgccgcggccgcgcaccatcgtggtcgccaaccacctccctatccgggctcaccgcccggcgtcgccgtcggagccgtggaccttctcctgggacgaggactccctcctccgccacctccagcactcgtcctcctcccccgccatggagttcatctacatcggctgcctccgcgacgacatcccgctggccgaccaggacgccgtcgcgcaggcgctcctcgagtcgtacaactgcgtgccggcgttcctgccccccgacatcgccgagcgctactaccatggcttctgcaagcagcatctgtggccgctgttccactacatgctgccgctctcccccgacctcggcggccgcttcgaccgcgcgctgtggcagtcgtacgtgtcggcgaacaagatcttcgcggacaaggtgctcgaggtgatcaacccggacgacgacttcgtgtgggtgcacgactaccacctcatggtgctcccaaccttcctccgcaagcgcttcaaccgcatcaagctcggcttcttcctccactcgccgttcccctcgtcggagatctacaagacgctccccgtccgggaggagctcctgcgcgcgctgctcaactccgacctcatcggcttccacaccttcgactacgcgcgccacttcctctcctgctgcggccggatgctggggctctcctacgagtccaagcgtggccacatctgcttggagtactacggccggacggtgagcatcaagatcctcccggtgggggtgaacatggggcagctcaagacggtgctcgcgttgccggagacggaggcgaaggtggcagagctgatggcgacttactccgggaaggggagggtcgtcatgctgggcgtcgacgacatggacatcttcaaggggatcagcctcaagctgctcgccatggaggagctgctgcggcagcaccccgagtggcgcggcaagctggtgctcgtccaggtcgcgaacccggcgcgcggccgcggcaaggacgtcgacgaggtgaagggggagacgtacgccatggtgcggcggatcaacgaggcgtacggcgcgcccgggtacgagccggtggtgctcatcgacgagccgctccagttctacgagcgcgtggcgtactacgtcgtcgccgaggtgtgcctggtgaccgcggtccgcgacggcatgaacctgatcccctacgagtacatcgtgtccaggcagggcaacgaggcgctcgacaggatgctgcagccgagcaagccggaggagaagaagagcatgctggtggtgtccgagttcatcgggtgctcgccgtcgctgagcggcgcggtgagggtgaacccgtggaacatcgaggccgtggcggacgccatggagagcgcgctcgtgctgccggagaaggagaagcggatgcgccacgacaagcactaccgctacgtggacacccacgacgtgggctactgggcgaccagcttcctgcaggacctcgagaggacgtgcaaggatcacgcgcagcggcggtgctggggcatcggcttcgggctgcggttcagggtggtgtcgcttgacctcagcttcaggaagctcgccatggagcacattgtcatggcgtaccggagggcgaagacgcgcgccatcctgctcgactacgacggcacgctcatgccgcaggcgatcaacaagagcccgagcgccaattccgtcgaaacgctgaccagcttgtgcagggacaagagcaacaaggttttcctctgcagcgggttcgagaagggaacactccatgactggttcccctgcgagaaccttggcttggcggctgagcacggttacttcctgaggtcatcgagggatgcagagtgggagatttccattccccccgcggactgcagctggaagcagatcgcggagccggtgatgtgcctgtacagggagaccacggacggctcgatcatcgagaacagggagacggtgctcgtctggaactacgaggacgcagaccctgacttcggttcatgccaagccaaggagctcgtcgaccacctcgagagcgtgctcgccaacgagcccgtctcggtgaagagcaccggccattccgttgaggtcaagccacagggcgtgagcaagggcctggtggcgcggcggctgctggcgagcatgcaggagaggggcatgtgcaccgacttcgtgctgtgcatcggggacgaccgctccgacgaggaaatgttccagatgatcacaagctccacctgcggcgagtcgctggcggccacggcggaggtcttcgcctgcaccgtcggccgcaagccgagcaaggccaagtactacctcgacgacacggcggaggtcgtcaggctgatgcagggcttggcctccgtctccaacgagctggctcgggcggcgagccccccggaggacgacgacgaatga

SEQ ID NO: 16 - protein, 860 aa, Oryza sativa
  Japonica cultivar group
MVSRSYSNLLDLATGAADQAPAPAALGALRRRLPRVVTTAGLIDDSPLSPSTPSPSPRPRTIVVANHLPIRAHRPASPSEPWTFSWDEDSLLRHLQHSSSSPAMEFIYIGCLRDDIPLADQDAVAQALLESYNCVPAFLPPDIAERYYHGFCKQHLWPLFHYMLPLSPDLGGRFDRALWQSYVSANKIFADKVLEVINPDDDFVWVHDYHLMVLPTFLRKRFNRIKLGFFLHSPFPSSEIYKTLPVREELLRALLNSDLIGFHTFDYARHFLSCCGRMLGLSYESKRGHICLEYYGRTVSIKILPVGVNMGQLKTVLALPETEAKVAELMATYSGKGRVVMLGVDDMDIFKGISLKLLAMEELLRQHPEWRGKLVLVQVANPARGRGKDVDEVKGETYAMVRRINEAYGAPGYEPVVLIDEPLQFYERVAYYVVAEVCLVTAVRDGMNLIPYEYIVSRQGNEALDRMLQPSKPEEKKSMLVVSEFIGCSPSLSGAVRVNPWNIEAVADAMESALVLPEKEKRMRHDKHYRYVDTHDVGYWATSFLQDLERTCKDHAQRRCWGIGFGLRFRVVSLDLSFRKLAMEHIVMAYRRAKTRAILLDYDGTLMPQAINKSPSANSVETLTSLCRDKSNKVFLCSGFEKGTLHDWFPCENLGLAAEHGYFLRSSRDAEWEISIPPADCSWKQIAEPVMCLYRETTDGSIIENRETVLVWNYEDADPDFGSCQAKELVDHLESVLANEPVSVKSTGHSVEVKPQGVSKGLVARRLLASMQERGMCTDFVLCIGDDRSDEEMFQMITSSTCGESLAATAEVFACTVGRKPSKAKYYLDDTAEVVRLMQGLASVSNELARAASPPEDDDE

SEQ ID NO: 17 - DNA, 2739 bp, Oryza sativa
  CDS (1)..(2739): Japonica cultivar group
atgtcgcggtcgtacaccaaccttctcgatctcgcggaggggaacttcgcggcgttgggcccgggaggcggcggcggcgggaggcggaggtcggggtcgttcgggctgaagcggatgtcgcgggtgatgacggtgcccgggacgctgtcggagctggacggggaggacgactcggagcacgcggcgacgaacagcgtcgcctccgacgtgccctcgtcggtggcgggggatcgagtcatagtggtctccaaccagctgcccgtcgtcgcacgccgccgtcccgacggccgcgggtggtccttctcatgggacgacgactcgctgctcctccagctccgcgacggcattcccgatgagatggaggtgttcttcgtcggttccctccgcgccgaaatccccgtcgccgaccaggaagaggtctcccaggcgctgctcgatcgcttccgatgtgctccggtgttcctccccgaccccctcaacgaacggttttaccaccgcttctgcaagcgccacctatggcctctgttccactacatgctccctttctcctcctccgcatccccgagtccctcctcctcctcctcctcctcctcctccccctcatcctcatccggcagtggccacttcgaccgcggcgcgtgggaggcctacgtgctcgcgaacaagttcttcttcgagaaggtcgtggaggtcatcaacccagaagacgactacgtatgggttcacgactaccatctcatggcgctgcccaccttccttcgccgccgcttcaaccgcctgcgcatcggcttcttcctccacagccccttcccctcgtcggagatctaccggaccctccctgttcgcgaggagatcctaaaggcgctgctcaattgtgaccttattggattccacacttttgactatgccagacatttcctctcttgttgtagtaggatgctgggaattgaataccagtcaaagcgtggatacattgggttggattactttgggcgtaccgttgggatcaaaatcatgccagtgggagttcatatgggtcaattgaagacggttctgagcttgcccgacagggaatggagggtctccgagctgcagcagcaatttgaggggaagactgtgttgctcggtgtggatgacatggatatcttcaagggtatcaacttgaagcttcttgccttcgagaatatgttgaggacacatcccaagtggcaggggcgggcagtgttggtgcaaattgctaatccggcccgtggaaagggtaaggatcttgaagccatccaggctgagattcatgagagctgcaagaggattaatggagagtttggccagtcaggatacagccctgttgtcttcattgaccgtgatgtgtcaagtgtggagaagattgcctactacacaatagcagaatgtgtggtggtgactgctgtgagggatgggatgaacttgacaccatatgaatatattgtctgtaggcaggggtctgactccacatcagaagtgaatggaccaaagaagagcatgctggtggtatcagaattcattgggtgctcaccatctctgagtggtgctatccgggttaacccatggaatatagaggcaaccgcagaggcactgaatgaggccatatcaatgtcggaacaggagaaacacctaaggcatgagaaacattaccgttatgtcagcacccacgatgttgcttattggtcgaaaagtttcatccaagatttggagagggcttgcaaggaccacttcaggaggacatgttggggcatcgggttggggtttggttttagggtggtggccttagatccccatttcacaaagcttaacatggattcaattgttatggcttatgagcggtcagagagtagggctatatttcttgattatgatggaacactggtgccacagacttccatcagtaggacacctagtgcggaagttttgaggatcatcaataccctgtgctcagataggaggaacaaagtttttcttgtcagtgggagacgcagggacaaattgggagaatggttttcctcttgtccagatctgggcattgcagcagagcatggttacttcttaaggtggactagagacgaagagtggcaaacatgtacccagacctctgacttcgggtggatggaaatggccaagccagtgatgaatctgtatacagaagcaactgatggatcttacattgatcctaaggaaagtgctttggtgtggcatcaccaggatgctgacccaggatttggatcctcccaggcaaaggagttacttgatcatctggaaagtgtattagcaaatgaacctgtttctgtcaaaagtggccagttcattgttgaagtcaaacctcagggagtaagcaagggagtagtagctgagaagatactcgtctcaatgaaggagagaggaaagcaggctgactttgtattatgcattggtgatgacaggtcggatgaggacatgtttgaaaacattgctgataccattaaaaagggtatggttgctacaaacacatcattgtttgcatgcactgtgggacaaaaaccaagcaaggccaaattttacctggatgatacgtttgaagtggtcaccatgctgagcgcactggcagatgctactgaaccagaacctgagactgatcttaccgatgagtttgatgaactggccgtgtctgtctcctcagttgatattgatgatgaacaaacgcccagtgataaactgatcggaggatag

SEQ ID NO: 18 - protein, 912 aa, Oryza sativa
  Japonica cultivar group
MSRSYTNLLDLAEGNFAALGPGGGGGGRRRSGSFGLKRMSRVMTVPGTLSELDGEDDSEHAATNSVASDVPSSVAGDRVIVVSNQLPVVARRRPDGRGWSFSWDDDSLLLQLRDGIPDEMEVFFVGSLRAEIPVADQEEVSQALLDRFRCAPVFLPDPLNERFYHRFCKRHLWPLFHYMLPFSSSASPSPSSSSSSSSSPSSSSGSGHFDRGAWEAYVLANKFFFEKVVEVINPEDDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGVHMGQLKTVLSLPDREWRVSELQQQFEGKTVLLGVDDMDIFKGINLKLLAFENMLRTHPKWQGRAVLVQIANPARGKGKDLEAIQAEIHESCKRINGEFGQSGYSPVVFIDRDVSSVEKIAYYTIAECVVVTAVRDGMNLTPYEYIVCRQGSDSTSEVNGPKKSMLVVSEFIGCSPSLSGAIRVNPWNIEATAEALNEAISMSEQEKHLRHEKHYRYVSTHDVAYWSKSFIQDLERACKDHFRRTCWGIGLGFGFRVVALDPHFTKLNMDSIVMAYERSESRAIFLDYDGTLVPQTSISRTPSAEVLRIINTLCSDRRNKVFLVSGRRRDKLGEWFSSCPDLGIAAEHGYFLRWTRDEEWQTCTQTSDFGWMEMAKPVMNLYTEATDGSYIDPKESALVWHHQDADPGFGSSQAKELLDHLESVLANEPVSVKSGQFIVEVKPQGVSKGVVAEKILVSMKERGKQADFVLCIGDDRSDEDMFENIADTIKKGMVATNTSLFACTVGQKPSKAKFYLDDTFEVVTMLSALADATEPEPETDLTDEFDELAVSVSSVDIDDEQTPSDKLIGG

SEQ ID NO: 19 - DNA, 2637 bp, Oryza sativa
  CDS (1)..(2637): Japonica cultivar group
atgttctcgcgatcctacaccaacctggtcgatctcgccaacggcaacctctccgccctggactatggtggcggagggggagggggcggcggcggcaacggggccgggggccggccgccgcgggcgaggcggatgcagcggacgatgacgacgcccgggacgctggcggagctcgacgaggagcgggccgggagcgtcacctccgacgtgccctcgtcgctcgccagcgaccgcctcatcgtcgtcgccaacaccctccccgtgcgctgcgagcgccgccccgacgggcgcgggtggagcttctgctgggacgaggactccctcctcctccacctccgcgacggcctccccgatgacatggaggtcctctacgtcggctccctccgcgccgacgtgccgtccgccgagcaggacgacgtcgcgcaggcgctcctcgaccggttccgctgcgtcccggctttcctccccaaggacgtcttggacagattctaccatggcttctgcaagcagacgctgtggccgctcttccactacatgctccccttcacctccgaccatggcggccgcttcgatcgctcccagtgggaggcatacgtcctcgccaacaagctcttctcccagcgcgtcatcgaggtcctcaaccccgaggatgactacatctggatccacgattaccacctcctcgccctcccgtccttccttcgccgtcggttcaacaggctccgcatcggtttcttcctgcacagcccgttcccttcgtcggaactctaccgttccctccctgttcgcgacgagatcctcaaatcactgctaaactgcgatctgattgggttccacacctttgattacgcgcggcatttcctgtcctgctgcagccggatgctggggatcgagtaccagtcgaagaggggatatatcggtctcgattactttggccgcactgttgggataaagatcatgcctgttgggattaacatgacgcagctgcagacgcagatccggctgcctgatcttgagtggcgtgtcgccgaactccggaagcagtttgatgggaagactgtcatgctcggtgtggatgatatggacatatttaaggggattaatctgaaagttcttgcgtttgagcagatgctgaggacacacccaaaatggcagcgcaaggcagtgttggtgcagattgcaaacccaaggggtggtggtgggaaggaccttgaagagatacaggctgagattgatgagagttgcaggaggataaatgcacaattttcacggccaggatatgttcctgtggtgattatcaatagagccctttcaagtgtggagaggatggcttattataccgtggcagagtgtgtcgttgtaactgcagtgagggatgggatgaacctcacaccatatgagtatattgtctgtagacagggatttccagatttggatggttctggggatgatgggccaaggagaaagagtatgttagttgtgtccgaattcattggttgctcaccatcacttagtggagcaattcgggtaaacccttggaacattgatacaacagcagaggcaatgaacgagtcgattgctttatcagagaacgagaagcaactgcggcatgagaagcattacagatatgtcagctcacatgatgttgcctattggtccaagagctatattcatgatttggagagaagctgcagggaccattttaggaggaggtgctggggtattggactaggatttggatttagagtagttgctcttgaccgcaacttcaaaaagcttactgtggattctatcgttactgattacaagaattctaagagcagggttatactgctagactacgatggaacgctagtaccacaaactacaatcaacaggactccaaatgaaagtgttgttaaaatcatgaatgctctttgtgacgataagaagaatgttgtttttattgttagtggacgaggaagggatagccttgagaaatggttttccccttgccaggatcttggcattgctgccgaacatggctactttatgaggtggaccagagatgagcaatggcaattgaataaccagtgctcagaatttggatggatgcagatggccaagccagttatgaacctgtatacagaagcaaccgatggatcatatattgaaaccaaagagagtgctttggtctggcaccaccaagatgctgaccctggttttggatcttcacaagctaaagagatgctagatcatttggaaagtgttcttgctaatgagcctgtctgtgtaaagagtggccaacagattgtggaagtgaaaccgcagggtgtcagcaaaggatttgttgctgagaagatcctatcaacgctgacagagaacaagagacaggcagattttgttctctgcataggcgatgatagatcagacgaggatatgtttgaaggaattgctgatatcatgagaaggagcatagttgatccccaaacatcattatatgcgtgcacagtcggccagaagccaagcaaggctaagtactatttggacgatactaatgatgttttgaacatgcttgaggcgcttgcagatgcatcagaggagactgattcacaggaagatgcagaagagataacatctatcccggacccggaatag

SEQ ID NO: 20 - protein, 878 aa, Oryza sativa
  Japonica cultivar group
MFSRSYTNLVDLANGNLSALDYGGGGGGGGGGNGAGGRPPRARRMQRTMTTPGTLAELDEERAGSVTSDVPSSLASDRLIVVANTLPVRCERRPDGRGWSFCWDEDSLLLHLRDGLPDDMEVLYVGSLRADVPSAEQDDVAQALLDRFRCVPAFLPKDVLDRFYHGFCKQTLWPLFHYMLPFTSDHGGRFDRSQWEAYVLANKLFSQRVIEVLNPEDDYIWIHDYHLLALPSFLRRRFNRLRIGFFLHSPFPSSELYRSLPVRDEILKSLLNCDLIGFHTFDYARHFLSCCSRMLGIEYQSKRGYIGLDYFGRTVGIKIMPVGINMTQLQTQIRLPDLEWRVAELRKQFDGKTVMLGVDDMDIFKGINLKVLAFEQMLRTHPKWQRKAVLVQIANPRGGGGKDLEEIQAEIDESCRRINAQFSRPGYVPVVIINRALSSVERMAYYTVAECVVVTAVRDGMNLTPYEYIVCRQGFPDLDGSGDDGPRRKSMLVVSEFIGCSPSLSGAIRVNPWNIDTTAEAMNESIALSENEKQLRHEKHYRYVSSHDVAYWSKSYIHDLERSCRDHFRRRCWGIGLGFGFRVVALDRNFKKLTVDSIVTDYKNSKSRVILLDYDGTLVPQTTINRTPNESVVKIMNALCDDKKNVVFIVSGRGRDSLEKWFSPCQDLGIAAEHGYFMRWTRDEQWQLNNQCSEFGWMQMAKPVMNLYTEATDGSYIETKESALVWHHQDADPGFGSSQAKEMLDHLESVLANEPVCVKSGQQIVEVKPQGVSKGFVAEKILSTLTENKRQADFVLCIGDDRSDEDMFEGIADIMRRSIVDPQTSLYACTVGQKPSKAKYYLDDTNDVLNMLEALADASEETDSQEDAEEITSIPDPE

SEQ ID NO: 21 - DNA, 2583 bp, Arabidopsis thaliana
  CDS (1)..(2583)
atggtttcaagatcgtattcaaatctgttggagttagcttcaggagactcaccaacgtttggacgcatgaaccgacaaatcccacgaatcatggccgttgctggaatcatgtcaaacatcgataatgactctaaagacactgatctgtctcctaaagatcgtatcatcattgtagccaatgaattacctatacgagctcagagaagggttgatggtaatggtagtggtagtagtagtagtagtacttgttgtagcaaaggttggaacttttcttgggatgagaattcacttcttctccaattgaaagatgggttaggagatgaagctattgaagttatctatgttggttgtttgaaagaagagattcctcttaatgagcaagaagaagtgtatcagattcttcttgagagtttcaagtgtgtgcctacgtttttgcctttggatttgtacactagatactaccatggattctgtaagcaacagctttggcctttgtttcattacatgttgccactttctcctgatcttggaggtaggtttgataggactttgtggcaagcttatgtctctgtgaacaagatttttgctgatagaattatggaggtgattaatcctgaggatgattttgtgtggatacatgattatcatttgatggttttgcctactttcttgaggaagaggtttaacagagtcaagcttggtttcttccttcatagtccatttccatcgtctgagatttacaaaactttgcctattcgtgaagagcttcttcgggctttgctaaactcggatttgatagggttccatacttttgactacgctaggcatttcttgtcttgttgtagtcgaatgcttggtcttacttatgaatctaagagaggatacattggacttgagtattatggtagaaccgtgagtatcaaaattctacctgttggaatccacatgggtcagcttcagtcggttttgagcttacccgagactgaaaggaaagtcggggaacttattgaacggtatggtcgaaaaggcaggacgatgctgcttggtgtggatgatatggacattttcaaagggattactttaaagctgttggctatggagcagctgcttatgcaacatcctgaatggcaagggaaggttgtgttggtgcagatagctaatccggcgagagggaaagggaaagatgttaaagagatgcaagctgagacgtattcaactgttaagcggattaatgaaacgtttgggagacccggttacgatcctatagtattgatcgatgcaccgttgaagttctatgaaagggttgcttattacgtagtagctgagtgttgtttggtgacagcggttagggatgggatgaatcttataccttatgagtacatagtttctcgtcaaggaaatgagaaactggacaaaattctgaagctggaggcgaataatcgtaacaagaaaagcatgctggtggtttctgagtttattggttgctctccatcgctaagcggagccattcgtgttaatccatggaatgttgatgcagtagctgatgcaatggatagtgcccttgaagtagctgaaccggagaagcagctaagacatgagaagcattacaagtatgtgagcacacatgatgttggctattgggctcgtagcttcctccaagatcttgagaggagttgtggtgagcatggacgaaggaggtgttggggaattgggtttggtctcagtttcagagttgtggcactagaccagagcttcaggaagctgtcaatggaacacatagtatcagcttataagaggacaaagacacgggctatccttttagactatgatgatactttaatgccacaaggctcgatcgataaaaggccttcatcgaagtcaatcgacatattgaacaccttgtgtagggacaagggcaatctggtgttcattgttagtgctaaaagccgagaaactctatcggactggtttagtccttgtgagaagcttggtattgctgctgaacatggctattttctgaggctaaggaaggcagtagagtgggaaaactgtgtggcagcagtagattgttcttggaagcaaattgccgagcctgtgatggaactctacaccgagacaaccgatggctcaacaattgaagacaaggagactgctcttgtttggagttatgaggatgctgaccctgattttggctcatgtcaagctaaggaacttctagatcatcttgaaagtgtccttgccaatgaacctgtaacagtgaaacgaggacagaactatgttgaggtcaagccacagggcgtgagcaagggacttatagcgagaaggatgctttcgatgatgcaagaaagaggaacacttcctgagtttgttctatgtattggagatgaccggtctgacgaagacatgtttgaggtgatctgcagttccactgaaggcccttcgattgccccaagagctgagattttcgcttgtactgtcggtcaaaagcctagcaaggccaagtattacctggatgacactactgagattgtcaggttaatgcatggtttagcttctgttacagaccagatcactcctgtttaa

SEQ ID NO: 22 - protein, 860 aa, Arabidopsis thaliana
MVSRSYSNLLELASGDSPTFGRMNRQIPRIMAVAGIMSNIDNDSKDTDLSPKDRIIIVANELPIRAQRRVDGNGSGSSSSSTCCSKGWNFSWDENSLLLQLKDGLGDEAIEVIYVGCLKEEIPLNEQEEVYQILLESFKCVPTFLPLDLYTRYYHGFCKQQLWPLFHYMLPLSPDLGGRFDRTLWQAYVSVNKIFADRIMEVINPEDDFVWIHDYHLMVLPTFLRKRFNRVKLGFFLHSPFPSSEIYKTLPIREELLRALLNSDLIGFHTFDYARHFLSCCSRMLGLTYESKRGYIGLEYYGRTVSIKILPVGIHMGQLQSVLSLPETERKVGELIERYGRKGRTMLLGVDDMDIFKGITLKLLAMEQLLMQHPEWQGKVVLVQIANPARGKGKDVKEMQAETYSTVKRINETFGRPGYDPIVLIDAPLKFYERVAYYVVAECCLVTAVRDGMNLIPYEYIVSRQGNEKLDKILKLEANNRNKKSMLVVSEFIGCSPSLSGAIRVNPWNVDAVADAMDSALEVAEPEKQLRHEKHYKYVSTHDVGYWARSFLQDLERSCGEHGRRRCWGIGFGLSFRVVALDQSFRKLSMEHIVSAYKRTKTRAILLDYDDTLMPQGSIDKRPSSKSIDILNTLCRDKGNLVFIVSAKSRETLSDWFSPCEKLGIAAEHGYFLRLRKAVEWENCVAAVDCSWKQIAEPVMELYTETTDGSTIEDKETALVWSYEDADPDFGSCQAKELLDHLESVLANEPVTVKRGQNYVEVKPQGVSKGLIARRMLSMMQERGTLPEFVLCIGDDRSDEDMFEVICSSTEGPSIAPRAEIFACTVGQKPSKAKYYLDDTTEIVRLMHGLASVTDQITPV

SEQ ID NO: 23 - DNA, 2253 bp, Oryza sativa
  CDS (1)..(2253): Japonica cultivar group
atgccttcgctctcctgccacaacctcctcgacctcgttgccgcggcggacgacgcggcgccgtcgcccgcgtcgctgcgcctcccgcgcgtcatgtcggcggcgtcgccggcctcgcccacgtcgccgtccacgccggcccccgcgcggagggtggtcgtgtcgcaccgcctcccgctccgcgccgcggccgacgcggcgtcgccgttcgggttctccttcacggttgactcggacgccgtcgcgtaccagctccgctcggggctgccccccggcgcgcccgtcctccacatcggcacgctcccgccgcccgcaaccgaggcggcctccgacgagctctgcaactacttgctggcgaacttctcttgcctgccggtgtacttgcccgccgatctccaccgccgattctaccatggattctgcaagcactacctgtggcctctcctccattaccttctgccgctcacgccgtcgtcgctgggcgggttgccgttcgaccgcgcgctctaccattctttcctctcggcgaaccgggccttcgccgaccgcctcaccgaggtgctcagccccgacgacgacctcgtctggatccacgattaccacctccttgccctccccaccttcctccgcaagcgattcccgcgcgccaaggtcggtttcttcctccactcgccgttcccctcctcggagatcttccgcaccattcccgtcagggaggacctcctccgcgccctcctcaacgccgacctcgtcggcttccacaccttcgactacgcgcgccacttcctctccgcctgctcgcggctgctcggcctggattaccagtccaagcgcggctacatcggcatcgagtactatggtcgcaccgtcacggtcaagattctgcccgtcgggatcgacatgggccagctgaggtcggtggtgtcggcgccggagacgggggacctggtgcggcggctcaccgagtcgtacaaggggcggcgcctgatggtcggcgtcgacgacgtcgacctgttcaagggaatcgggctcaagttcctggcgatggagcagctgctggtggagcacccggagctgcgcggccgcgcggtgctcgtgcagatcgcgaacccggcgcgcagcgaggggcgcgacatccaggaggttcagggagaagccagggcgatcagcgcccgcgtcaatgcgcggttcggcacgccggggtacacccctatcgtgctgatcgaccgcggtgtgtcggtgcacgagaaggcggcgtactacgcggcggccgagtgctgcgtggtgagcgccgtgcgggacggcctcaaccggataccctacatctacacggtgtgccggcaggagagcactggcctggatgatgcggccaagcgcagcgtcattgtgctgtcggagttcgtcgggtgctccccgtcgctcagcggcgcaatccgggtcaacccatggagtgtggagtctatggcagaggccatgaatgcagccctgaggatgcctgagccagagcagcggctgcgacatgagaagcactacaagtatgtgagcacccatgatgttgcctactgggcgaaatctttcgaccaggacctgcagcgagcttgcaaggatcatttctcgcggcggcattggggtattgggtttgggatgagtttcaaggtggtggcacttggcccgaatttcaggcggctgtctgtcgatcacattgtgccgtcataccggaagtctgataatcgcttaattctcttggactatgatggcacagtgatgccagagggttcaattgataaggcaccgagcaatgaggtcatctctgtattgaatcgtctgtgcgaggaccccaagaacagagtgttcatcgtgagcggtagagggaaggatgaacttggcagatggtttgcaccttgtgagaagctggggattgctgcagagcatggttacttcacaaggtggagcagggactcagcttgggagacctgcgggttggccgtggactttgattggaagaagactgcagaaccagtgatgaggctttacaaggaggcaacagatggttcaaccatcgaagacaaggaaagcgcgttagtttggcaccacgatgaggcagatccagattttggttcatgccaggcaaaggaactgcttgaccacctcgaaaacgttcttgcaaatgaaccagtcgttgttaagaggggccagcatatcgtcgaagtaaatccacaggtaagcgcctgccatcttccttccttcctctag

SEQ ID NO: 24 - protein, 750 aa, Oryza sativa
  Japonica cultivar group
MPSLSCHNLLDLVAAADDAAPSPASLRLPRVMSAASPASPTSPSTPAPARRVVVSHRLPLRAAADAASPFGFSFTVDSDAVAYQLRSGLPPGAPVLHIGTLPPPATEAASDELCNYLLANFSCLPVYLPADLHRRFYHGFCKHYLWPLLHYLLPLTPSSLGGLPFDRALYHSFLSANRAFADRLTEVLSPDDDLVWIHDYHLLALPTFLRKRFPRAKVGFFLHSPFPSSEIFRTIPVREDLLRALLNADLVGFHTFDYARHFLSACSRLLGLDYQSKRGYIGIEYYGRTVTVKILPVGIDMGQLRSVVSAPETGDLVRRLTESYKGRRLMVGVDDVDLFKGIGLKFLAMEQLLVEHPELRGRAVLVQIANPARSEGRDIQEVQGEARAISARVNARFGTPGYTPIVLIDRGVSVHEKAAYYAAAECCVVSAVRDGLNRIPYIYTVCRQESTGLDDAAKRSVIVLSEFVGCSPSLSGAIRVNPWSVESMAEAMNAALRMPEPEQRLRHEKHYKYVSTHDVAYWAKSFDQDLQRACKDHFSRRHWGIGFGMSFKVVALGPNFRRLSVDHIVPSYRKSDNRLILLDYDGTVMPEGSIDKAPSNEVISVLNRLCEDPKNRVFIVSGRGKDELGRWFAPCEKLGIAAEHGYFTRWSRDSAWETCGLAVDFDWKKTAEPVMRLYKEATDGSTIEDKESALVWHHDEADPDFGSCQAKELLDHLENVLANEPVVVKRGQHIVEVNPQVSACHLPSFL

SEQ ID NO: 25 - DNA, 2700 bp, Oryza sativa
  CDS (1)..(2700): Japonica cultivar group
atgatgtcgaggtcgtacacgaacctgctggacctcgcggcggggaacttcgaggcgctggggccggcggggggagggaggaggaggtcgttcggggcgaagcggatgacgcgggtgatgacggtgcccgggacgctgtcggagctggacgacgaggacgacgagccggcggcgacgagcagcgtcgcctccgacgtgccctcgtcggcggcgtgcgagcgcctcatcgtcgtggcgaaccagctccccgtggtggcgcggcggaggccgggcgccgcggcgggggggtgggcgttctcgtgggacgacgactcgctcctcctccgcctccgcgacggcgtccccgacgagatggaggtgctcttcatcggcacgctccgcgccgacgtgcccgcctgcgagcaggacgaggtgtcgcagagcctcatcgatggattcggatgcgcacccgtgttcctccccgcggggctctacgaccgattctaccagcacttctgcaagggttacctatggccgctgttccactacatgctccccttcgcctccgccttgccggcggccgcatccggcgatggccggtttgaccgcggcgcgtgggaggcctacgtgctcgccaacaaatacttcttcgagaaggtggtcgaggtcatcaacccggaggacgactacgtttgggtccacgattaccacctcatggcgctgcccaccttcctccgccgccgcttcaatcgcctccgcatcgggttcttcctccacagcccctttccctcatcggagatctaccgctcgctgcccgtccgagaggagatcctaagaacgctgcttaattgcgatctcattggattccacacattcgattatgcgaggcacttcctatcttgctgtagtaggatgctggggatagagtaccagtcaaagcgtggatacattggattggattactttggccgcactgttggaatcaagatcatgccagtgggaatccatatgggtcaattgcaatcagtgttgcgattgtccgagaaagaaaagaaggttgctgagctgcggcagcaattcgagggcaagtccgtgttacttggtgtggatgatatggatatcttcaagggaatcaacttaaaacttcttgcgtttgagaatatgctgaggacgcatcccaagtggaagggaagagctgtgttggtgcagattgcaaacccagcacgagggaagggaaaggatctggaggctgtccaggctgagattcgggagagttgtgatagaattaacaaggagtttggccagtcaggttacagtccagtgattttcattgaccagagcgtgccaagtgcggtgaggcttgcatattatacggttgctgagtgtgttgtggtgacggctgtgagggatgggatgaatttgaccccatatgaatacattgtctgccgggaggggatacctggctctgagtgtgcaccagaggtgagtggaccaaagaagagcatgttggttgtgtcggagtttattggttgctcaccttcactgagtggagccattcgtgttaacccgtggaatatcgaggcaactgcagaggcactgaatgaggccatctcaatgtcagagcgtgaaaagcagctgaggcacgaaaaacattaccgttatgtcagcacccatgatgttgcatattggtctaagagctttgtacaggacctggagagggcttgcaaggatcactttaggaaaccatgctggggcattggattgggatttggcttcagggtggtagccctagacccacatttcacaaagcttaatttcgattcaattataatgtcctatgagagatcaaagagtagggctatatttctcgactatgatggcacattggtgccacaggcttcgctcaacaagaatccaagtgaagaattactgaggatcattaataccctatgcgcagatagaaataacaccgtgttcattgtcagcgggagaagcaaggatgacttgagcaaaaagcttatctcatgtccaaagctaggcattgccgcagagcatggctacttcttaaggtggactagagatgaagaatggcaaaccactgcacagacctcagattttggatggatgcaaatggcgaagccagtgatggatctttatactgaatcaactgacggatccaccattgagactaaagaaactgcactggtgtggcaccatcaggatgctgaccaaggttttggctcttcccaggcaaaggaaatgcttgatcacttggaaagtgtattagcaaatgaaccagtctcagtcaagagtggccaattcattgttgaagtcaaacctcagggtgttaccaaagggctcatagctgagaaagtactcacatcaatgaaggagaaggggcaactggcagattttgtattatgcattggtgatgacaggtcagatgaggatatgtttgaaaatattgccgatgtcatgaaaaggagcattgttgcaccaaaaactccactgtttgcatgtactgtgggccagaagccaagcaaagctaggttttacctggatgatacatttgaagtcgtcaccatgttgagttcactggcggatgcttcagaaccagaccttatggcagacttggaagatgacttggccacatcagtctcatcaatagaaataagtgacagagtggtatcttttagtaatttaaggacagaaggatcttag

SEQ ID NO: 26 - protein, 899 aa, Oryza sativa
  Japonica cultivar group
MMSRSYTNLLDLAAGNFEALGPAGGGRRRSFGAKRMTRVMTVPGTLSELDDEDDEPAATSSVASDVPSSAACERLIVVANQLPVVARRRPGAAAGGWAFSWDDDSLLLRLRDGVPDEMEVLFIGTLRADVPACEQDEVSQSLIDGFGCAPVFLPAGLYDRFYQHFCKGYLWPLFHYMLPFASALPAAASGDGRFDRGAWEAYVLANKYFFEKVVEVINPEDDYVWVHDYHLMALPTFLRRRFNRLRIGFFLHSPFPSSEIYRSLPVREEILRTLLNCDLIGFHTFDYARHFLSCCSRMLGIEYQSKRGYIGLDYFGRTVGIKIMPVGIHMGQLQSVLRLSEKEKKVAELRQQFEGKSVLLGVDDMDIFKGINLKLLAFENMLRTHPKWKGRAVLVQIANPARGKGKDLEAVQAEIRESCDRINKEFGQSGYSPVIFIDQSVPSAVRLAYYTVAECVVVTAVRDGMNLTPYEYIVCREGIPGSECAPEVSGPKKSMLVVSEFIGCSPSLSGAIRVNPWNIEATAEALNEAISMSEREKQLRHEKHYRYVSTHDVAYWSKSFVQDLERACKDHFRKPCWGIGLGFGFRVVALDPHFTKLNFDSIIMSYERSKSRAIFLDYDGTLVPQASLNKNPSEELLRIINTLCADRNNTVFIVSGRSKDDLSKKLISCPKLGIAAEHGYFLRWTRDEEWQTTAQTSDFGWMQMAKPVMDLYTESTDGSTIETKETALVWHHQDADQGFGSSQAKEMLDHLESVLANEPVSVKSGQFIVEVKPQGVTKGLIAEKVLTSMKEKGQLADFVLCIGDDRSDEDMFENIADVMKRSIVAPKTPLFACTVGQKPSKARFYLDDTFEVVTMLSSLADASEPDLMADLEDDLATSVSSIEISDRVVSFSNLRTEGS

SEQ ID NO: 27 - DNA, 2589 bp, Oryza sativa
  CDS (1)..(2589): Japonica cultivar group
atggtttcaaaatcttattcaaatctgttagaaatgagttgtggagatggagttgactttcggcaaccttttaaatctcttcctcgtgtggtaacctctcctggcattatatctgatcctgattgggacactagaagtgatggcgattcagttggttcagcatcttctgttgagaggaaaataattgttgccaacttccttccactgaactgtacaaaagatgaagctgggcaatggtccttctcaagggatgatgatgcactgctcatgcaacttaaagatggtttttcaaatgagactgatgtcatttatgtgggtagtttgaaggttcaggtagatcccagtgagcaggatcaagttgcacagaagcttcttagagattaccgatgcatacctacttttctccctcctgacctccagcagcagttctatcatggcttctgtaaacagcaattgtggccacttttccactatatgcttcccatttgtcttgacaaaggtgagctctttgatcgctccctgtttcaagcctatgtccgagctaacaaactctttgccgacaaagttatggaagctattaatacggatgatgatcatgtctgggttcatgattatcacctcatgcttctcccaacatttctgaggaagaggttacaccgaataaagctaggattttttctccacagtccatttccctcctcagaaatctacaggtcactgcctgtaagggatgagatcctgaagtcattgcttaatgctgatcttattggtttccaaacatttgactatgcccgccacttcctttcttgttgcagcagattattgggtctgcattatgaatcaaagcgcggttacattggaatagattactttggaagaacagtgagcctgaagatcctctcagtgggtgtccatgttggccgtcttgagtccatcctaaagttgcctgctacagtaaagaaggttcaagaaattgaacaaaggtataaaggcaagatgctcatgttaggtgtagatgacatggacatcttcaaaggaatcagtctaaaactgcttgggttggagctacttctagataggaacccgaaactcagagggaaggttgtccttgtacagattgtcaatccagcaagaagcacagggaaagacgtggaggaagcaataacagaatctgtctctgtagctgaaagaatcaaccttaagtatggctctgtagattacaagcctgttgtccttattgatcatcgcataccattttatgaaaagattgcattctatgctgcatctgattgttgtattgtaaatgctctgagggatggtatgaacttggtaccatatgagtacactgtttgccggcagggaaatgaggagatagataatgccagaggcagtgacacaaattgccatcacacaagcacactaattgtgtctgagtttgttggttgctcaccatctcttagtggtgctttcagggtaaatccttggagtgttgacgatgtggctgatgccttacaccatgcaacagacttgactgaatccgagaaaaggctacggcatgaaaagcactaccgttatgttagatctcatagtgttgcttactgggctcatagctttgctcaagatctggaaagggcatgcaaagatcactacagccgaaggtgctgggctattggttttggtctgaacttcagagttattgctctttctcctggctttagaaagctctctttggaacactttgcttcttcttacaacaaggctaccagaagggcaatatttcttgactatgatggcactcttgtaccccagtcatcaatcaataaagctccaagcgatgaacttattactattctcaacagcttgtgtgatgacccgaagaatgatgtattcatagtcagtggaagagcgcgtagtttgcttgatgagtggtttgctccatgtcagaagcttggtattgcagcagaacatggctattttgtcagatggaacaaagcagctgaatgggaatcaagctatccaaaccatgattttgagtggaagcacatcgctgaaccggtcatgcaagtttacaccgaaacaactgatgggtcctccatagagccaaaggaaagtgctctagtatggcattatttggatgcagaccatgacttcggttcctgccaagcaaaggaactactgggtcatcttgaaagggtgctatcaaatgaacctgttgttgtgaagtgtggtcattacattgttgaagtcaaaccacagggagttagcaagggtcttgttgtggacaaggtaattcacagattgatgaacaacgggaagacgcctgatttcgtagtgtgcatcggtaacgatcgatctgatgaggacatgttcaaaagcatcgacagcatgacctccagctccgcattccctgcagttccagaagtctttgcctgttcagttggtcagaaacccagcaaggcaaagtactatgtcgacgatgctggtgaagtagtaagattgctcaagaatgtagctggcatttcgtcgcaccgggaggccgtcagccatggacgtgtgaccttcagggatgtgatggattatgtggagtga

SEQ ID NO: 28 - protein, 862 aa, Oryza sativa
  Japonica cultivar group
MVSKSYSNLLEMSCGDGVDFRQPFKSLPRVVTSPGIISDPDWDTRSDGDSVGSASSVERKIIVANFLPLNCTKDEAGQWSFSRDDDALLMQLKDGFSNETDVIYVGSLKVQVDPSEQDQVAQKLLRDYRCIPTFLPPDLQQQFYHGFCKQQLWPLFHYMLPICLDKGELFDRSLFQAYVRANKLFADKVMEAINTDDDHVWVHDYHLMLLPTFLRKRLHRIKLGFFLHSPFPSSEIYRSLPVRDEILKSLLNADLIGFQTFDYARHFLSCCSRLLGLHYESKRGYIGIDYFGRTVSLKILSVGVHVGRLESILKLPATVKKVQEIEQRYKGKMLMLGVDDMDIFKGISLKLLGLELLLDRNPKLRGKVVLVQIVNPARSTGKDVEEAITESVSVAERINLKYGSVDYKPVVLIDHRIPFYEKIAFYAASDCCIVNALRDGMNLVPYEYTVCRQGNEEIDNARGSDTNCHHTSTLIVSEFVGCSPSLSGAFRVNPWSVDDVADALHHATDLTESEKRLRHEKHYRYVRSHSVAYWAHSFAQDLERACKDHYSRRCWAIGFGLNFRVIALSPGFRKLSLEHFASSYNKATRRAIFLDYDGTLVPQSSINKAPSDELITILNSLCDDPKNDVFIVSGRARSLLDEWFAPCQKLGIAAEHGYFVRWNKAAEWESSYPNHDFEWKHIAEPVMQVYTETTDGSSIEPKESALVWHYLDADHDFGSCQAKELLGHLERVLSNEPVVVKCGHYIVEVKPQGVSKGLVVDKVIHRLMNNGKTPDFVVCIGNDRSDEDMFKSIDSMTSSSAFPAVPEVFACSVGQKPSKAKYYVDDAGEVVRLLKNVAGISSHREAVSHGRVTFRDVMDYVE

SEQ ID NO: 29 - DNA, 2598 bp, Arabidopsis thaliana
  CDS (1)..(2598)
atgatttctgactacttgagacattgtatctacttcacttgctgtagagatatggtatcaagatcttattcaaacctcttggatcttgcttctggtaacttccattcgttttctcgagaaaagaagaggtttccaagagtagcaactgtcactggtgtcttatctgagctagatgatgataacaacagcaacagtgtctgctctgatgctccttcttccgtcacacaagatcgaatcatcatcgttggaaaccagcttcctattaaatcacatcggaactctgctggtaaattgagttttagttgggacaatgactcgcttctcttgcagcttaaagatggtatgcgtgaagatatggaagttgtctacattggttgccttaaggaacagattgatacagttgagcaagatgatgtttctcaaaggttgcttgagaatttcaaatgtgttcctgcttatatcccacctgagctattcactaagtactatcatggattctgtaagcaacatctatggcctttgtttcactacatgcttcccttaactcctgatcttggtggtagatttgatcgttctttatggcaagcttatctttcggttaacaagatctttgctgataaagtgatggaagtgattagtcctgatgatgattttgtttgggttcatgactatcacttaatggttttgcctacatttctaaggaagaggtttaatagagtaaagcttggttttttccttcatagcccgttcccttcctctgagatttaccgtactcttccagtgagaaatgagctcttacgtgcactcctcaacgctgatttgattggctttcatacctttgactatgcaagacacttcctttcttgttgtagcaggatgcttggtttatcctatcagtccaaacgtggaaccatagggcttgagtattatggtcgaacgcttcagtcaattttaaacctcccagagactcagaccaaagttgctgagctaagagatcagttcttggatcagaaagttcttctcggtgttgatgacatggacatcttcaaaggaatcagcctcaaactcttggcaatggaacaacttctcacacagcatcccgagaagagaggtcgagttgtacttgtccagattgcaaaccctgcaagaggtcgtgggaaagacgttcaggaggttcagtctgaaactgaagccacggttaaaaggatcaatgaaatgtttggaaggccgggctaccaacccgtggttctgattgatacaccgcttcaattctttgagaggattgcttactatgtcattgcagagtgttgtcttgttacagcggtaagagatggtatgaatcttataccttatgagtacattatctgcaggcaaggtaatccgaaactcaacgagactataggccttgacccttctgctgcaaagaagagtatgcttgttgtctctgagtttattggttgttctccttctttaagcggcgccattagagtaaatccgtggaacattgatgctgtgactgaagcaatggactatgcattgatagtttcagaagcagagaagcaaatgcgtcacgagaagcatcacaaatatgttagcacacatgatgttgcttattgggcgcgtagctttatacaagatcttgaaagggcttgcggggatcatgtgaggaagaggtgttgggggattggattcgggttaggctttagagttgtggcgcttgatccgagttttaaaaagctttcgattgagcacattgtctcagcttataagagaaccaagaaccgagccattttgttggattatgatggcacaatggtgcagccaggttccattaggacaacaccaacccgcgaaacaatcgaaatcttgaacaacctgtctagtgatcccaagaatatcgtgtacctcgtcagtgggaaagacagaaggacactaactgaatggttttcttcatgtgacgatctcggtttgggtgcagagcacgggtattttataaggccaaatgatggaacagactgggaaacgtcgagtttggtatcaggttttgagtggaaacaaatagcagagccagtgatgagactttacactgagactacagatggatcaacaatagagactaaagagactgctctcgtttggaattaccaattcgcagatcctgattttggatcttgtcaagccaaagagcttatggaacacctcgaaagcgtgcttaccaatgatccagtctctgtcaagactggacaacaactcgttgaagttaaaccacagggtgtgaacaaaggtcttgtggcagagaggcttctaacaacgatgcaagaaaaagggaaacttttggatttcattctctgcgtcggtgatgatcggtctgatgaggatatgtttgaggtgataatgagtgctaaagatggtccagctttgtctcctgtggctgagatattcgcttgcaccgttggacaaaagccaagcaaagcaaaatactatttagacgatactgcggagataatcagaatgctggacggtctagccgctaccaacacaactatctctgatcaaactgattcaaccgccactgttccaactaaagatctgttttaa

SEQ ID NO: 30 - protein, 865 aa, Arabidopsis thaliana
MISDYLRHCIYFTCCRDMVSRSYSNLLDLASGNFHSFSREKKRFPRVATVTGVLSELDDDNNSNSVCSDAPSSVTQDRIIIVGNQLPIKSHRNSAGKLSFSWDNDSLLLQLKDGMREDMEVVYIGCLKEQIDTVEQDDVSQRLLENFKCVPAYIPPELFTKYYHGFCKQHLWPLFHYMLPLTPDLGGRFDRSLWQAYLSVNKIFADKVMEVISPDDDFVWVHDYHLMVLPTFLRKRFNRVKLGFFLHSPFPSSEIYRTLPVRNELLRALLNADLIGFHTFDYARHFLSCCSRMLGLSYQSKRGTIGLEYYGRTLQSILNLPETQTKVAELRDQFLDQKVLLGVDDMDIFKGISLKLLAMEQLLTQHPEKRGRVVLVQIANPARGRGKDVQEVQSETEATVKRINEMFGRPGYQPVVLIDTPLQFFERIAYYVIAECCLVTAVRDGMNLIPYEYIICRQGNPKLNETIGLDPSAAKKSMLVVSEFIGCSPSLSGAIRVNPWNIDAVTEAMDYALIVSEAEKQMRHEKHHKYVSTHDVAYWARSFIQDLERACGDHVRKRCWGIGFGLGFRVVALDPSFKKLSIEHIVSAYKRTKNRAILLDYDGTMVQPGSIRTTPTRETIEILNNLSSDPKNIVYLVSGKDRRTLTEWFSSCDDLGLGAEHGYFIRPNDGTDWETSSLVSGFEWKQIAEPVMRLYTETTDGSTIETKETALVWNYQFADPDFGSCQAKELMEHLESVLTNDPVSVKTGQQLVEVKPQGVNKGLVAERLLTTMQEKGKLLDFILCVGDDRSDEDMFEVIMSAKDGPALSPVAEIFACTVGQKPSKAKYYLDDTAEIIRMLDGLAATNTTISDQTDSTATVPTKDLF

SEQ ID NO: 31 - DNA, 2490 bp, Medicago truncatula
  CDS (1)..(2490)
atgaacaattacgaacaagaagacctaaacatagttccagaactcatgacaccgttccagaagtttcaacgacaatattccaacgtttcagttccttcatctccgatttctcgtaaacgaagaatgataatagtatcaaatcagttaccaatacgcgttgtttcatcttcttcttgtgacttgaaattcgaatgggacgttgatagcatatattttcagctcaaagacggtatttcctctgattctgaactcttttacgttggttcgttaaaatcacatattgaaattgaaccatcacagcaagaagaagttgccaaagtcttgttagaaaagtttcgctgtgttccaacttttctaccttctgaaactcacaactatttttaccatggtttttgtaagcattatctttggcctttgtttcactacatgctacctctgtccaagagtcaaggtgtgcgtttcaattcctctcattggctttcatacaaaaaggccaatagaatcttcgcggacaaggttcgcgaggttttgaatcctgatgaagattatgtctgggttcatgattatcatctaatggttttaccaacttacttgaggaaacgttttcctaaagtcaaattgggtttttttcttcacaacacgtttcctacttcagaaatctatagaacaatacctgttcgtgaagaaattcttaggggtttgttgaactgtgatttgattggatttcatacttttgattatgctagacattttctgtcttgttgtagtaggatgttgggtttggattatgagtctaaaagaggttacattggtgttgattactttggaagaaatgttaccatcaagattcttcctgtggggatccacatgggtcttctcgaattggttttgtcgtcctctgaaacagctaagagggtgaaagagttgaaggaagaatttgaagggaaggttttgattttgggggttgatgacttggatttgttcaaaggtattgggttgaagtttctggcattgaggaatcttttggagggaaatgaaaaattaaggggtgaagttgtgttggttcagattctgaatcaagcaaggagtagcggaaaagatatacaggatgtgaagtttgagattgaagctattgccaaagaagttaatgacaaatatggtgatgaacaatctgggtataggccaattgtttgtataaatggtccggtttcgactcaggagaaggctgcttactatgctatatcagagtgttgtattgtgaatgctgtgagggatgggatgaatttgattccttacgagtatactgtttgtagacaaggaagtgttgaattggacaaaacacttggagtgggaaatgatgagcctaaaaatagtgttatcattgtttctgagttcattggttgttcgccttcactcagcggggcagttcgggtgaatccgtggaacattgatgatgtttcagagaaaatgaactcagcaatcaaaatgaaggattccgagaagcaattgcggcacaagaagaattataagtacataagctctcatgatgtagcgtattgggccaagagttttgatcaggatttagagagagcttgtagggagcattatctcaagacatatgtgggattaggacttgataattttagaatcattgctttggatcctagttttaagaagctttgtcttgatgacattgcccctgcttacaaagataccaaaagtaggttgatccttttggactatgatggcaccatgatgcctcagggatcaattaacaaagctcctagtttggatgttatctctctcttgaattccttatgcagtgatcccaaaaatacagtgttcattgttagtggcaggggaagagtttgccttagcgactggttttctccatgtgacaaattgggtctctctgcagaacatggttacttcacaaggtggagtaaggattctccttggacgactctcggattggcatcagattttgattggaaaattaatgtagaaaaggtgatggcgctttacacagaagcgactgatggttccttcattgaagaaaaagaaagtgcaatggtttggcaacatcaagaagcagatcctgattttggactgtggcaagctaaagagcttcttgttcaccttgagagtatgctggccaatgatcctgtagtagttaaaaggggacaacatattgttgaagtaaagcctcagggtgtgagcaaaggtaaagtggtggaagagcttatatcaaccatgaggaatgaggagaagtcaccagattttcttctatgtctaggagatgatcgttcagatgaagatatgtttgaaagcattgcaaatttagccttaccaacctcatcacaagtgtttgcatgcactattggttataaaccaagtagggctaaatactatttggatgatactggtcacgttatcagactgctggaaggacttgctgctgcatcagcgcaaaatttaagcacaaaatag

SEQ ID NO: 32 - protein, 829 aa, Medicago truncatula
MNNYEQEDLNIVPELMTPFQKFQRQYSNVSVPSSPISRKRRMIIVSNQLPIRVVSSSSCDLKFEWDVDSIYFQLKDGISSDSELFYVGSLKSHIEIEPSQQEEVAKVLLEKFRCVPTFLPSETHNYFYHGFCKHYLWPLFHYMLPLSKSQGVRFNSSHWLSYKKANRIFADKVREVLNPDEDYVWVHDYHLMVLPTYLRKRFPKVKLGFFLHNTFPTSEIYRTIPVREEILRGLLNCDLIGFHTFDYARHFLSCCSRMLGLDYESKRGYIGVDYFGRNVTIKILPVGIHMGLLELVLSSSETAKRVKELKEEFEGKVLILGVDDLDLFKGIGLKFLALRNLLEGNEKLRGEVVLVQILNQARSSGKDIQDVKFEIEAIAKEVNDKYGDEQSGYRPIVCINGPVSTQEKAAYYAISECCIVNAVRDGMNLIPYEYTVCRQGSVELDKTLGVGNDEPKNSVIIVSEFIGCSPSLSGAVRVNPWNIDDVSEKMNSAIKMKDSEKQLRHKKNYKYISSHDVAYWAKSFDQDLERACREHYLKTYVGLGLDNFRIIALDPSFKKLCLDDIAPAYKDTKSRLILLDYDGTMMPQGSINKAPSLDVISLLNSLCSDPKNTVFIVSGRGRVCLSDWFSPCDKLGLSAEHGYFTRWSKDSPWTTLGLASDFDWKINVEKVMALYTEATDGSFIEEKESAMVWQHQEADPDFGLWQAKELLVHLESMLANDPVVVKRGQHIVEVKPQGVSKGKVVEELISTMRNEEKSPDFLLCLGDDRSDEDMFESIANLALPTSSQVFACTIGYKPSRAKYYLDDTGHVIRLLEGLAAASAQNLSTK

SEQ ID NO: 33 - DNA, 2574 bp, Brassica oleracea
  CDS (1)..(2574)
atggtatcaagatcctattccaacctcttggatctcgcttcaggcaacttccactccttctcccgggaaaagaagaggttcccaagagtagcaaccgtcacaggcgtcttatccgagctagacgacgacgccaacagcaacagcgtctgctccgacgctccatcctccatcgcgcaagaccgaatcatcatcgttggaaaccagctccccatcaaatcccatcgcaacccatccggtaaactcaccttcacctgggacaacgactccctcctcttgcagctcaaagacggcatgcgcgaagacatggaagtcgtctacatcggctgcctcaaagaccaagtagacccatccgagcaagacgacgtctcccaaagactcctcgagaatttcaaatgcgtccctgcttacatcccgcctgagatattcaccaagtactaccacggcttctgcaagcagcatctatggcccttgtttcactacatgcttcctctaaaccctgatctcggaggcaggttcgaccgctccttatggcaagcgtacctctccgttaacaagatcttcgctgacaaagtcatggaagtgattaaccctgacgatgacttcgtttgggttcatgactaccacttgatggttctgcctactttcttgcggaagaggtttaacagagtgaagctagggttcttcctccacagccccttcccttcttcagagatttaccgaactctccctgtcagaaacgagctcttacgcgccctactcaacgctgatctgattggctttcacacctttgactacgcgaggcacttcctctcttgctgcagcaggatgctaggcttgtcctaccagtccaaaagaggaaccatagggcttgagtactacggcagaacggtcagcatcaagatcctccccgtcgggatccacaccagccagcttcagtcgattctaaacctccccgagactcagaccaaagtcgctgaccttagagaccagttctcggaccagaaggtcctcctcggcgtcgacgacatggacatcttcaaaggaatcagcctcaagctcctggctatggagcagcttctccagcagcatccggagaagcgaggacgagttgtactcgtccagatcgccaaccccgcgagaggccgcgggaaagacgtccaggaggttcggtccgaaaccctagccaccgttaaacggatcaacgacacgttcggaaggccagggtaccagcctgtgtttctcatcgatgaaccgcttcagttctacgagaggatcgcttactacgtgatcgcagagtgttgtcttgtcaccgcagtgagagacggtatgaatcttatcccttatgagtatatcatctgcagacaagctaaccccaagctcaacgagacgttaggactcgacccttgcgctgcgaagaagagcatgcttgtagtctccgagttcatcggttgctctccttctctaagcggcgccattagagtgaacccgtggaacatcgacgcggtcaccgaggctatggactacgcgttgacagtttcggaagcggagaagcaaatgcgtcacgagaagcatcacaagtacgtgagcacccatgatgttgcctactggtcgcgcagctttatacaggatctcgagagggcgtgcgcggagcacgtgaggaagaggtgctgggggatagggttcgggttagggtttagggttgtggcgcttgatccgagttttaagaagctttctattgagcacattgtctcggcttataagaggaccaagaagagagctattcttgtggattacgatggcacgatggtgcagcctgggtccattaggacgacgcctagcatccaaacgatcgagaccttgaacaagctgtcgagtgaccccaagaatatcgtttatctcatcagcgggaaagatcgaaagacgctaaccgaatggttttcctcttgtggtgatcttggtttggccgcagagcatggatactttataaggccaaatgatggaacagagtgggaaacatcgagtttagtgtcggcttttgagtggaaacaaatagcagagccagtgatgagactctacactgagacgacagatggatcaacaatagagactaaagagactgctctcgtttggaactacgagtttgctgatcctgacttcggatcttgtcaagctaaagagcttatggaacacttagaaagcgtgctcacgaatgatccagtctctgtcaaaaccggacaacaactcgttgaagttaaaccacagggtgtgaacaaaggtcttgtggcagagaggcttctaacgacgatgcaggaacaagggaagctgttggatttcattctatgcgtgggagatgatcggtctgatgaggatatgtttgaggtgataatgggtgctaaagatggtcctgctttatctccagtggctgagatcttcgcttgcaccgttggtcaaaagccaagcaaagctaagtactacttagacgacactgcagagatcatcagaatgcttgaaggtctagccacctctgatcaaacctcttcaaccgtggatgttccaacaaaagatatcttctaa

SEQ ID NO: 34 - protein, 857 aa, Brassica oleracea
MVSRSYSNLLDLASGNFHSFSREKKRFPRVATVTGVLSELDDDANSNSVCSDAPSSIAQDRIIIVGNQLPIKSHRNPSGKLTFTWDNDSLLLQLKDGMREDMEVVYIGCLKDQVDPSEQDDVSQRLLENFKCVPAYIPPEIFTKYYHGFCKQHLWPLFHYMLPLNPDLGGRFDRSLWQAYLSVNKIFADKVMEVINPDDDFVWVHDYHLMVLPTFLRKRFNRVKLGFFLHSPFPSSEIYRTLPVRNELLRALLNADLIGFHTFDYARHFLSCCSRMLGLSYQSKRGTIGLEYYGRTVSIKILPVGIHTSQLQSILNLPETQTKVADLRDQFSDQKVLLGVDDMDIFKGISLKLLAMEQLLQQHPEKRGRVVLVQIANPARGRGKDVQEVRSETLATVKRINDTFGRPGYQPVFLIDEPLQFYERIAYYVIAECCLVTAVRDGMNLIPYEYIICRQANPKLNETLGLDPCAAKKSMLVVSEFIGCSPSLSGAIRVNPWNIDAVTEAMDYALTVSEAEKQMRHEKHHKYVSTHDVAYWSRSFIQDLERACAEHVRKRCWGIGFGLGFRVVALDPSFKKLSIEHIVSAYKRTKKRAILVDYDGTMVQPGSIRTTPSIQTIETLNKLSSDPKNIVYLISGKDRKTLTEWFSSCGDLGLAAEHGYFIRPNDGTEWETSSLVSAFEWKQIAEPVMRLYTETTDGSTIETKETALVWNYEFADPDFGSCQAKELMEHLESVLTNDPVSVKTGQQLVEVKPQGVNKGLVAERLLTTMQEQGKLLDFILCVGDDRSDEDMFEVIMGAKDGPALSPVAEIFACTVGQKPSKAKYYLDDTAEIIRMLEGLATSDQTSSTVDVPTKDIF

SEQ ID NO: 35 - DNA, 2586 bp, Gossypium hirsutum
  CDS (1)..(2586)
atggcatcaagaccatgtgcaaattttttacacttagcctctgggaatctacttgatatttctcaaactccgagaggtcttcctcgggtaatgactgttcctgggattatctctgacatggactcttgtagcagtaatgatggggattcagatgttgcttcatctgggtgtagagaacgcaaaattatagtggcaaatatgttacctttgcatgctaaaagggatcgtgaaacttcgaaatggcgcttcagctgggatgaggattcacttttactacatctaaagggtgggttttctcctgaaacggaggttgtattcgtaggatctctcaaggttgatatagatgtgaatgaacaggaagaagctgcccaaaagctgttagaagatttcaattgcgtccctacatttttacctcatgatttgcagaagaagttttatcttggcttctgcaaacagcatttgtggcctctttttcactacatgctgcccatgtgtcctgaccatggcgatcggtttgaccgtattttatggcaggcatatgtttctgctaataaagtatttgccgacaaggttatggaagtaattaatccagatgatgattatgtctggattcatgattatcatttgatagttcttcccacatttttgaggaagcacctgaatagaatcaagcttggttttttcctccacagcccgttcccttcatcagaaatatatcgaacattgcctgttcgggatgaaattctgaggggactactgaattgcgatctaattggttttcatacgttcgattatgcacgacatttctcgtcttgctgcagtagaatgctgggtcttgattatgaatctaaaagagggcatattggtcttgattactttggtcgcacggtttttattaaaattctacctgtaggagttcatatgggtagacttgaatcagtcttgaatctttcctctactgctgccagggtcaaagagattcagaaacagtttgaagggaaaaaattgattcttggcatagatgatatggatattttcaaaggcatcagtcttaaattactggctgtggaacagctcttacagcagcacccagacctgcagggtaaaatagtcctggttcagattgtgaatcctgcaaggggctttggaaaggatgtccaggaggctaagaaggagacttatatgactgctaaaaagatcaatgaggtttatggttcccccaattatcagccagtgattttgattgatcgccctgttccctgttatgagaaatcggcctattatgcgctagcagaatgttgcatagtaaatgctgtgagggatgggatgaacctggttccttacaagtatattgtttgtcggcagggaactcctggcatggatgaggcactgggtgtaaagccagaatatccacgaacaagcatgcttgttgtttctgagttcatcggttgctcaccatctttaagtggagcgattagggtaaatccatgggatattgatgctgtggctgaggctttaaatacagctattaccatgcctgagtcagagaagcaattgcgacatgagaaacactaccggtatgtcagcactcatgatgtggcatattgggctcgcagcttagtgatggacttggatagagcatgccaggatcactatagtaaacgttgctggggcattggtttgggcctaagtttcagagttgtgtctctttcacctaattttaggaggctagctatcgatcacatttgttcagcatatagacgaacaagtagaagagcaatattcctggactatgatggcactcttgttcctgaagcttccattatcaaaactcctagccctgaggttatctctatcattaagaccctctgtgatgatcctaagaacacagtgtttattgttagtgggagaggaagagcttcgcttagtgattggcttgctccatgtgagaagctggggatagccgctgaacacgggtacttcataagatggagtaaagactccgaatgggaaaccagccctgttggtgctgaccttgaatggaaaaagattgttgaacctgttatgagcctgtatagagaggcaactgatggctccagcatagagaccaaggagagtggtttggtgtggcaccatcaagatgcagaccctgacttcggatcatgccaagccaaggaattgttggatcatttggaaagtgttctcgcaaatgaaccagcggttgtccatagaggccagcatattgttgaagttaagccgcagggagtaagcaaagggctggtagcagagaaagttttgtcgagaatggtaaatggtgggaagccacctgatttcgtgatgtgtgttggtgatgataaatccgatgaagatatgtttcagagcatattaacttcagtttctaatccatccttgcctgtggctccggaaatctttgcatgcacagtggggcgaaagcctagcaaagctaggtattacctcgatgacactgcagatgttttaaagttacttaaaggccttgcaactgctacaatttcaaagcctaggtgcctgcctgagattaaggtatctttcgagagtaatgcttga

SEQ ID NO: 36 - protein, 861 aa, Gossypium hirsutum
MASRPCANFLHLASGNLLDISQTPRGLPRVMTVPGIISDMDSCSSNDGDSDVASSGCRERKIIVANMLPLHAKRDRETSKWRFSWDEDSLLLHLKGGFSPETEVVFVGSLKVDIDVNEQEEAAQKLLEDFNCVPTFLPHDLQKKFYLGFCKQHLWPLFHYMLPMCPDHGDRFDRILWQAYVSANKVFADKVMEVINPDDDYVWIHDYHLIVLPTFLRKHLNRIKLGFFLHSPFPSSEIYRTLPVRDEILRGLLNCDLIGFHTFDYARHFSSCCSRMLGLDYESKRGHIGLDYFGRTVFIKILPVGVHMGRLESVLNLSSTAARVKEIQKQFEGKKLILGIDDMDIFKGISLKLLAVEQLLQQHPDLQGKIVLVQIVNPARGFGKDVQEAKKETYMTAKKINEVYGSPNYQPVILIDRPVPCYEKSAYYALAECCIVNAVRDGMNLVPYKYIVCRQGTPGMDEALGVKPEYPRTSMLVVSEFIGCSPSLSGAIRVNPWDIDAVAEALNTAITMPESEKQLRHEKHYRYVSTHDVAYWARSLVMDLDRACQDHYSKRCWGIGLGLSFRVVSLSPNFRRLAIDHICSAYRRTSRRAIFLDYDGTLVPEASIIKTPSPEVISIIKTLCDDPKNTVFIVSGRGRASLSDWLAPCEKLGIAAEHGYFIRWSKDSEWETSPVGADLEWKKIVEPVMSLYREATDGSSIETKESGLVWHHQDADPDFGSCQAKELLDHLESVLANEPAVVHRGQHIVEVKPQGVSKGLVAEKVLSRMVNGGKPPDFVMCVGDDKSDEDMFQSILTSVSNPSLPVAPEIFACTVGRKPSKARYYLDDTADVLKLLKGLATATISKPRCLPEIKVSFESNA

SEQ ID NO: 37 - DNA, 2586 bp, Gossypium hirsutum
  CDS (1)..(2586)
atggcatcaagatcatgtgcaaattttttacacttagcctctgggaatctacttgatattcctcaaactccgagaggtcttcctcgggtaatgactgttcctgggattatctctgacatggactcttgtagcagtaatgatggggattcagatgttgcttcatctgggtgtagagaacgcaaaattatagtggcaaatatgttacctttgcatgctaaaagagatcgtgaaacttcgaaatggcgcttcagctgggatgaggattcacttttactacatctaaaggatgagttttctcctgaaatggaggttgtatacgtaggatctctcaaggttgatatagatgtgaatgaacaggaagaagttgcccaaaagctgttagaagatttcaattgcgtccctacatttgtacctcatgatttgcagaagaagttttatcttggcttctgcaaacagcatttgtggcctctttttcactacatgctgcccatgtgtcctgaccatggtgatcggtttgaccgcattttatggcaggcatatgtttctgctaataaaatatttgctgacaaggttatggaagtaatcaatccagatgatgattatgtctggattcatgattatcatttgatggttcttcccacatttttgaggaagcacctgaatagaatcaagcttggttttttcctccacagcccgtacccttcatcagaaatatatcgaacattgcctgttcgggatgaaattctgaggggactactgaattgcgatctaattggttttcatacgttcgattatgcacgacatttcttatcttgctgcagtagaatgctgggtcttgattatgaatctaaaagagggcatattggtcttgattactttggtcgcacggtttttattaagattctacctgtaggagttcatatgggtagacttgaatcagtcttgaatctttcctctactgctgccagggtcaaagagattcagaaacagtttgaagggaaaaaattgattcttggcatagatgatatggatattttcaaaggcatcagtcttaaattactggctgtggaacagctcttacagcagcacccagacctgcagggtaaaatagtcctggttcagattgtgaatcctgcaaggggctttggaaaggatgtccaggaggctaagaaggagacttatatgactgctaaaaagatcaatgaggtttatggttcccccaattatcagccagtgattttgattgatcgccctgttccccgttatgagaaatcggcctattatgcgctagcagaatgttgcatagtaaatgctgtgagggatgggatgaacctggttccttacaagtatattgcttgtcggcagggaactcctggcatggatgaggcactgggtgtaaagccagaatatccacgaacaagcatgcttgttgtttctgagctcatcggttgctcaccgtctttaagtggagcaattagggtaaatccatgggatatcgatgctgtggctgaggctttaaatacagctattaccaagcccgagtcagagaagcaattgcgacatgagaaacactaccggtatgtcagtactcatgatgtggcatattgggctcgcagctttgtgatggacttggatagagcatgccaggatcactatagtaaacgttgctggggcattggtttgggcctcagtttcagagttgtgtctctttcacctagttttaggaggctagctatcgatcacatttgttcggcatatagacgaacaaatagaagagcaatattcctggactatgatggcactcttgttcctgaagcttccattatcaaaactcctagccctgaggttatctgtatcattaagaccctctgtgatgatcctaagaacacagtgtttattgttagtgggagaggaagagcttcgcttagtgattggcttgctccatgtgagaagctggggatagccgctgaacacgggtacttcataagatggagtaaagactctgaatgggaaaccagccctgttggtgctgaccttgaatggaaaaagattgtggaacctgttatgagcttgtatagagaggcaactgatggctccagcatagagaccaaggagggtggtttggtgtggcaccatctagatgcagaccctgacttcggatcatgccaagccaaggaattgttggatcatttggaaagtgttctcgcaaatgaaccagcggttgtccatagaggccagcatattgttgaagttaagccgcagggagtaagcaaagggctagtagcagaaaaagttttgtcgagaatggtcaatggtgggaagccacctgatttcgtgatgtgtgttggtgatgataaatccgatgaagatatgtttcagagcatattaacttcagtttctaatccatccttgcctgtggctccggaaatctttgcatgcacagtggggcgaaagcctagcaaagctaggtattacctcgatgacactgcagatgttttaaagttacttaaaggccttgcaactgctacaatttcaaagcctaggtgcctgcctgagattaaggtatctttcgagagtaatgcttga

SEQ ID NO: 38 - protein, 861 aa, Gossypium hirsutum
MASRSCANFLHLASGNLLDIPQTPRGLPRVMTVPGIISDMDSCSSNDGDSDVASSGCRERKIIVANMLPLHAKRDRETSKWRFSWDEDSLLLHLKDEFSPEMEVVYVGSLKVDIDVNEQEEVAQKLLEDFNCVPTFVPHDLQKKFYLGFCKQHLWPLFHYMLPMCPDHGDRFDRILWQAYVSANKIFADKVMEVINPDDDYVWIHDYHLMVLPTFLRKHLNRIKLGFFLHSPYPSSEIYRTLPVRDEILRGLLNCDLIGFHTFDYARHFLSCCSRMLGLDYESKRGHIGLDYFGRTVFIKILPVGVHMGRLESVLNLSSTAARVKEIQKQFEGKKLILGIDDMDIFKGISLKLLAVEQLLQQHPDLQGKIVLVQIVNPARGFGKDVQEAKKETYMTAKKINEVYGSPNYQPVILIDRPVPRYEKSAYYALAECCIVNAVRDGMNLVPYKYIACRQGTPGMDEALGVKPEYPRTSMLVVSELIGCSPSLSGAIRVNPWDIDAVAEALNTAITKPESEKQLRHEKHYRYVSTHDVAYWARSFVMDLDRACQDHYSKRCWGIGLGLSFRVVSLSPSFRRLAIDHICSAYRRTNRRAIFLDYDGTLVPEASIIKTPSPEVICIIKTLCDDPKNTVFIVSGRGRASLSDWLAPCEKLGIAAEHGYFIRWSKDSEWETSPVGADLEWKKIVEPVMSLYREATDGSSIETKEGGLVWHHLDADPDFGSCQAKELLDHLESVLANEPAVVHRGQHIVEVKPQGVSKGLVAEKVLSRMVNGGKPPDFVMCVGDDKSDEDMFQSILTSVSNPSLPVAPEIFACTVGRKPSKARYYLDDTADVLKLLKGLATATISKPRCLPEIKVSFESNA

SEQ ID NO: 39 - DNA, 2607 bp, Ginkgo biloba
  CDS (1)..(2607)
atgatgtcaagatcttatacaaatcttatggatctggccacggggaatttcccggcctttggacgagctaccaagcggcttcctagagtcatgactgtgcctgggatcatctctgagctcgacgatgacaatagcaatagtgtgtcatcagatgtgccttcttccatctgccaggagcgcatgatcattgtagctaaccagcttcctttgcgggcacagaggaggccagataatagaggctgggcttttagttgggacgaggattctttgcttttgcagctcaaggatggcttagcagaggatatggaagtagtctatgttggtagcttgaaggtggaagttgaccttagcgaacaagatgatgttgcacagattctacttgaaaatttcaagtgcgtgccagcttttctccctccggaacttttgaccaaattttaccatggattctgcaagcagcagctctggccactattccattatatgttacctctttctccagatcacggaggtcgctttgatcggtctctctggcaggcttatgtatctgcaaataagatttttgcagacaaggtaatggaggtgatcagccctgatgatgactatgtctgggtgcacgattaccatctcatggtcctgcctacgtttcttaggaagcgatctaacagggtgaagcttggttttttcctgcacagccccttcccttcatcggaaatctaccgaactcttcctgttagagatgagattcttagggccctcctgaactcagatttgattggtttccataccttcgactatgcgaggcattttctatcctgctgcagcaggatgctgggtcttgagtatgaatctaagagagggtacattgggttggaatactatggccggactgtgggcattaagatcctccctgtgggcatacacatgggtcagcttgaatctgtgttgaatcttgctgacacagagtggagagtcggagaactgagggaccagttcaaggggaaaattcttcttcttggtgtcgatgacatggatatcttcaaaggcatcagcttgaagtttctggcaatggagcagctacttaagctgcatccagagtggagaggcaaggtagtgttagtgcagattgctaatcctgcaaggggtaggggcaaagatgtggaggatgtgcaagctgagacacattctacggccaagagaataaatgaaacctttgggcgcccgggctatgaacctgtggtgttgatagacagacctgttcctttctatgagagaatagccttctacaccattgcagaatgttacgtaataactgctgtgagggatgggatgaatctcactccctatgaatacattgtttgcaggcaggggagtccaagattgaatgaaaccttgggagtgagtccgaatgtttcgaagaagagcatgctggttgtgtctgagtttattggatgctcaccttctctcagcggggctatcagggtcaatccttggaacattgatgctgtagctgaggccatgagcacagccattacaatgcctgagacggaaaaacaactaagacatgaaaaacattacaggtatgttagtacccatgatgtggggtattgggcacacagttttatgcaagatctagagagagcgtgcaaggatcacttccgtaggaggtgctggggtattgggtttgggttgggattcagggtagtagcacttgatccaaacttcagaaagctttcaacagagcacattgtctctgcatacaagaggaccaagagtagggcaatattgttggactatgatggtacaatgatgcctcagacttctatcaacaaaactcctgggtcggaggtgctttttattttgaacagcttgtgcagtgatccaaagaatgttgttttcattgttagtggaaggggaaggcagactcttagtcaatggttgtctccttgcgaaatgttggggattgcagcagagcatggctattttataaggtggactcgagatgcagaatgggaaacttgtgttcagggtgtagattttggttggaaacaaataacggagcctgtcatgaaattatatactgagactacggatggctctgtaattgaaacaaaagagagcgctttggtttggcatcatcaagatgctgatccggactttggttcctgtcaggcaaaggagcttctagatcatttggagagtgtacttgcaaatgagcctgtggttgtcaaaagtggtcaacatattgtagaggtgaaacctcagggtgtgagcaagggcctagtagcagagcgacttctttcaataatggtgcaaaatgacaagcgaccagactttgtcatgtgcattggagatgacagatcagatgaagacatgtttgaggggataacaagtgctatggcaggaccttcactttctccaatagcagaagtatttgcatgtactgttggtcagaagcccagcaaagcaaagtactatcttgatgatactgtagaagttctaagaatgcttcagggtctggcggctgcctctgatcaaacagcaaagacttcatctgatcaagcagcaaagaatccatctgctcaagtagctcttgagtgctcactttga

SEQ ID NO: 40 - protein, 868 aa, Ginkgo biloba
MMSRSYTNLMDLATGNFPAFGRATKRLPRVMTVPGIISELDDDNSNSVSSDVPSSICQERMIIVANQLPLRAQRRPDNRGWAFSWDEDSLLLQLKDGLAEDMEVVYVGSLKVEVDLSEQDDVAQILLENFKCVPAFLPPELLTKFYHGFCKQQLWPLFHYMLPLSPDHGGRFDRSLWQAYVSANKIFADKVMEVISPDDDYVWVHDYHLMVLPTFLRKRSNRVKLGFFLHSPFPSSEIYRTLPVRDEILRALLNSDLIGFHTFDYARHFLSCCSRMLGLEYESKRGYIGLEYYGRTVGIKILPVGIHMGQLESVLNLADTEWRVGELRDQFKGKILLLGVDDMDIFKGISLKFLAMEQLLKLHPEWRGKVVLVQIANPARGRGKDVEDVQAETHSTAKRINETFGRPGYEPVVLIDRPVPFYERIAFYTIAECYVITAVRDGMNLTPYEYIVCRQGSPRLNETLGVSPNVSKKSMLVVSEFIGCSPSLSGAIRVNPWNIDAVAEAMSTAITMPETEKQLRHEKHYRYVSTHDVGYWAHSFMQDLERACKDHFRRRCWGIGFGLGFRVVALDPNFRKLSTEHIVSAYKRTKSRAILLDYDGTMMPQTSINKTPGSEVLFILNSLCSDPKNVVFIVSGRGRQTLSQWLSPCEMLGIAAEHGYFIRWTRDAEWETCVQGVDFGWKQITEPVMKLYTETTDGSVIETKESALVWHHQDADPDFGSCQAKELLDHLESVLANEPVVVKSGQHIVEVKPQGVSKGLVAERLLSIMVQNDKRPDFVMCIGDDRSDEDMFEGITSAMAGPSLSPIAEVFACTVGQKPSKAKYYLDDTVEVLRMLQGLAAASDQTAKTSSDQAAKNPSAQVALECSL

SEQ ID NO: 41 - DNA, 2742 bp, Oryza sativa
  CDS (1)..(2742)
atgatgtcgcggtcgtacaccaaccttctcgatctcgcggaggggaacttcgcggcgttgggcccgggaggcggcggcggcgggaggcggaggtcggggtcgttcgggctgaagcggatgtcgcgggtgatgacggtgcccgggacgctgtcggagctggacggggaggacgactcggagcacgcggcgacgaacagcgtcgcctccgacgtgccctcgtcggtggcgggggatcgagtcatagtggtctccaaccagctgcccgtcgtcgcacgccgccgtcccgacggccgcgggtggtccttctcatgggacgacgactcgctgctcctccagctccgcgacggcattcccgatgagatggaggtgttcttcgtcggttccctccgcgccgaaatccccgtcgccgaccaggaagaggtctcccaggcgctgctcgatcgcttccgatgtgctccggtgttcctccccgaccccctcaacgaacggttttaccaccgcttctgcaagcgccacctatggcctctgttccactacatgctccctttctcctcctccgcatccccgagtccctcctcctcctcctcctcctcctcctccccctcatcctcatccggcagtggccacttcgaccgcggcgcgtgggaggcctacgtgctcgcgaacaagttcttcttcgagaaggtcgtggaggtcatcaacccagaagacgactacgtatgggttcacgactaccatctcatggcgctgcccaccttccttcgccgccgcttcaaccgcctgcgcatcggcttcttcctccacagccccttcccctcgtcggagatctaccggaccctccctgttcgcgaggagatcctaaaggcgctgctcaattgtgaccttattggattccacacttttgactatgccagacatttcctctcttgttgtagtaggatgctgggaattgaataccagtcaaagcgtggatacattgggttggattactttgggcgtaccgttgggatcaaaatcatgccagtgggagttcatatgggtcaattgaagacggttctgagcttgcccgacagggaatggagggtctccgagctgcagcagcaatttgaggggaagactgtgttgctcggtgtggatgacatggatatcttcaagggtatcaacttgaagcttcttgccttcgagaatatgttgaggacacatcccaagtggcaggggcgggcagtgttggtgcaaattgctaatccggcccgtggaaagggtaaggatcttgaagccatccaggctgagattcatgagagctgcaagaggattaatggagagtttggccagtcaggatacagccctgttgtcttcattgaccgtgatgtgtcaagtgtggagaagattgcctactacacaatagcagaatgtgtggtggtgactgctgtgagggatgggatgaacttgacaccatatgaatatattgtctgtaggcaggggtctgactccacatcagaagtgaatggaccaaagaagagcatgctggtggtatcagaattcattgggtgctcaccatctctgagtggtgctatccgggttaacccatggaatatagaggcaaccgcagaggcactgaatgaggccatatcaatgtcggaacaggagaaacacctaaggcatgagaaacattaccgttatgtcagcacccacgatgttgcttattggtcgaaaagtttcatccaagatttggagagggcttgcaaggaccacttcaggaggacatgttggggcatcgggttggggtttggttttagggtggtggccttagatccccatttcacaaagcttaacatggattcaattgttatggcttatgagcggtcagagagtagggctatatttcttgattatgatggaacactggtgccacagacttccatcagtaggacacctagtgcggaagttttgaggatcatcaataccctgtgctcagataggaggaacaaagtttttcttgtcagtgggagacgcagggacaaattgggagaatggttttcctcttgtccagatctgggcattgcagcagagcatggttacttcttaaggtggactagagacgaagagtggcaaacatgtacccagacctctgacttcgggtggatggaaatggccaagccagtgatgaatctgtatacagaagcaactgatggatcttacattgatcctaaggaaagtgctttggtgtggcatcaccaggatgctgacccaggatttggatcctcccaggcaaaggagttacttgatcatctggaaagtgtattagcaaatgaacctgtttctgtcaaaagtggccagttcattgttgaagtcaaacctcagggagtaagcaagggagtagtagctgagaagatactcgtctcaatgaaggagagaggaaagcaggctgactttgtattatgcattggtgatgacaggtcggatgaggacatgtttgaaaacattgctgataccattaaaaagggtatggttgctacaaacacatcattgtttgcatgcactgtgggacaaaaaccaagcaaggccaaattttacctggatgatacgtttgaagtggtcaccatgctgagcgcactggcagatgctactgaaccagaacctgagactgatcttaccgatgagtttgatgaactggccgtgtctgtctcctcagttgatattgatgatgaacaaacgcccagtgataaactgatcggaggatag

SEQ ID NO: 42 - protein, 913 aa, Oryza sativa
MMSRSYTNLLDLAEGNFAALGPGGGGGGRRRSGSFGLKRMSRVMTVPGTLSELDGEDDSEHAATNSVASDVPSSVAGDRVIVVSNQLPVVARRRPDGRGWSFSWDDDSLLLQLRDGIPDEMEVFFVGSLRAEIPVADQEEVSQALLDRFRCAPVFLPDPLNERFYHRFCKRHLWPLFHYMLPFSSSASPSPSSSSSSSSSPSSSSGSGHFDRGAWEAYVLANKFFFEKVVEVINPEDDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGVHMGQLKTVLSLPDREWRVSELQQQFEGKTVLLGVDDMDIFKGINLKLLAFENMLRTHPKWQGRAVLVQIANPARGKGKDLEAIQAEIHESCKRINGEFGQSGYSPVVFIDRDVSSVEKIAYYTIAECVVVTAVRDGMNLTPYEYIVCRQGSDSTSEVNGPKKSMLVVSEFIGCSPSLSGAIRVNPWNIEATAEALNEAISMSEQEKHLRHEKHYRYVSTHDVAYWSKSFIQDLERACKDHFRRTCWGIGLGFGFRVVALDPHFTKLNMDSIVMAYERSESRAIFLDYDGTLVPQTSISRTPSAEVLRIINTLCSDRRNKVFLVSGRRRDKLGEWFSSCPDLGIAAEHGYFLRWTRDEEWQTCTQTSDFGWMEMAKPVMNLYTEATDGSYIDPKESALVWHHQDADPGFGSSQAKELLDHLESVLANEPVSVKSGQFIVEVKPQGVSKGVVAEKILVSMKERGKQADFVLCIGDDRSDEDMFENIADTIKKGMVATNTSLFACTVGQKPSKAKFYLDDTFEVVTMLSALADATEPEPETDLTDEFDELAVSVSSVDIDDEQTPSDKLIGG

SEQ ID NO: 43 - DNA, 2601 bp, Oryza sativa
  CDS (1)..(2601)
atggtttcgagatcctactccaacttgctggggcggcgacggattccgcgggtggtgacggcgtcgggcattgtcccggacctggactactccgacgacgacgcggcgtcggcggcgtcgtcgtccgaccactcctccgcccactcccacgcgccgcgcgagcgcgccatcatcgtcgccaaccagctgcccatccgcgcgtctcgccgcggcggcggcggcggcgggtgggagttctcctgggacgaggacagcctcctcctgcagctcagggacagcctccgcgcccacgccgaccgcgccgacgacatggagttcgtctacgtcggcggcctccgcgacgacgtgcccgcggcggagcacgacgaggtggcgcaccacctcctcgagggcttccgctgcgtgcccaccttcctccccgccgacctccggtcgcggttctaccacggattctgcaagcagcagctgtggccactgttccattacatgctcccgctgtcgccggagctcggcggccgcttcgaccgcgcgctgtggcaggcgtacgtgtccgtcaacaagatcttcgccgacaagatactggaggtgatcagccccgacgaggactacgtctgggtgcacgactaccatctcatgatcttgccgacgttcctgcggaagcggttcaaccgcgtcaagctcggcttcttcctccacagcccgttcccgtcgtcggagatctacaagaccctgcccgtccgcgaggagctgctccggtcgctcctgaacgccgatttgatcgggttccacaccttcgattatgccaggcatttcctgtcctgctgtggaaggatgctcgggttgaagtatgagtcgcagaggggctacattgcgctggagtattatggtcggacggttaccatcaagatattgccggtgggagttcatttggagcagctgcggtcggtgctcaatcttccggagacgggggtcaaggtggccgagcttctcaagcaattctgcgatcagaaccggctgatgttgcttggcgtagatgatatggacatctttaaaggaattagcttgaagcttttggcatttgagcagctcctgatgcaacatcccgaatggcgaggaagggtggttctagtacagattgccaatccagcgaggggacgggggaaagatgtgaaagaggtgcaggatgagagctatgcaatggtgaggcgtatcaatgaggcatttgggcagccaggttaccagccggttatattgatcgatcggccacttcagttctatgagagaatggcttactatgttgtcgctgagtgctgcctggtgaccgcagtgagagatggcatgaatcttatcccgtatgagtatgtaattgctaggcagggcaatgaaaaactagacgggatcttaggtcttggcccatcggcacggaagaagagcatgcttgttgtgtcagagttcatcggctgttcaccttccctaagtggtgcgattcgggtaaacccttggaacatcgatgctgtggctgatgcaatggactctgctttagagatgcctgaaggggagaaggtgctgagacatgagaagcaccacaaatatgtgagcacacatgatgttggatactgggcaaacagcttcttgcaagatctggagaggacttgtctggaccatagcaggaggcgttgttgggggataggattcgggctaaggtttagggttgtagcccttgatccaaacttcaagaagcttgcagttgagcaccttgtctcagcctaccggaggacgaccacgcgaatcattcttttggactatgacgggacgctgatgcctcaaacatcatttggtaagagcccaagctctaaaacgatagatatgctgaacagcctgtcccgtgatcagaacaacatggtcttccttgtgagcacaaagaagcggtcgactctagaagaatggttctcatcatgcgacaacctaggcttagctgctgagcatggatactttctcaggctgaagagagatgcagaatgggagacgtgtgtcccagtgacagacagaagctggaagcaaatcgcagagcctgtgatgaaaacatacaccgagacaacagatgggtcaacaattgaggacaaggagaccgcgatagtgtggagctacgaggatgctgatcctgattttggatcttgccaagccaaggagctccatgaccatctggagagtgtccttgcaaatgagccagttacagtaaaagctggcctgaaccatgtcgaggtgaagccacagggtgtaagcaagggccttgtggcaaaacggcttttgtcgataatacgggagaacagcctccttccggactttgtcctctgcatcggtgatgaccgctccgatgaagacatgttcgaggtgatcaccactgcagcacaggacaactgcctaagcccagacgccgaggtcttcgcctgcaccgttggtcgcaagcccagcaaggccaagtactacctggatgacctggccgacattgtgaggctgatccagggcctcgccaatgtctctgacgagatgcacagcacaatgcccacacctgtcgacgccgcagacaccgccctgaggtga

SEQ ID NO: 44 - protein, 866 aa, Oryza sativa
MVSRSYSNLLGRRRIPRVVTASGIVPDLDYSDDDAASAASSSDHSSAHSHAPRERAIIVANQLPIRASRRGGGGGGWEFSWDEDSLLLQLRDSLRAHADRADDMEFVYVGGLRDDVPAAEHDEVAHHLLEGFRCVPTFLPADLRSRFYHGFCKQQLWPLFHYMLPLSPELGGRFDRALWQAYVSVNKIFADKILEVISPDEDYVWVHDYHLMILPTFLRKRFNRVKLGFFLHSPFPSSEIYKTLPVREELLRSLLNADLIGFHTFDYARHFLSCCGRMLGLKYESQRGYIALEYYGRTVTIKILPVGVHLEQLRSVLNLPETGVKVAELLKQFCDQNRLMLLGVDDMDIFKGISLKLLAFEQLLMQHPEWRGRVVLVQIANPARGRGKDVKEVQDESYAMVRRINEAFGQPGYQPVILIDRPLQFYERMAYYVVAECCLVTAVRDGMNLIPYEYVIARQGNEKLDGILGLGPSARKKSMLVVSEFIGCSPSLSGAIRVNPWNIDAVADAMDSALEMPEGEKVLRHEKHHKYVSTHDVGYWANSFLQDLERTCLDHSRRRCWGIGFGLRFRVVALDPNFKKLAVEHLVSAYRRTTTRIILLDYDGTLMPQTSFGKSPSSKTIDMLNSLSRDQNNMVFLVSTKKRSTLEEWFSSCDNLGLAAEHGYFLRLKRDAEWETCVPVTDRSWKQIAEPVMKTYTETTDGSTIEDKETAIVWSYEDADPDFGSCQAKELHDHLESVLANEPVTVKAGLNHVEVKPQGVSKGLVAKRLLSIIRENSLLPDFVLCIGDDRSDEDMFEVITTAAQDNCLSPDAEVFACTVGRKPSKAKYYLDDLADIVRLIQGLANVSDEMHSTMPTPVDAADTALR

SEQ ID NO: 45 - DNA, 2574 bp, Solanum tuberosum
  CDS (1)..(2574)
atgatgtctagatcgtataccaatcttttggatttggcatctgggaattttccagtaatgggaagagagagggataggcgacggatgtcgcgggtaatgacagttcctgggagtatatgtgaactggatgatgaccaggctgttagtgtttcttctgataatcaatcttcacttgctggtgatcggatgattgttgtggcaaatcagttgccattgaaagcgaaaaggagaccggataataagggctggagttttagttggaatgaggattctttgcttttgagacttaaggatggtttacctgaagatatggaagtattgtttgttgggtctttatctgttgatgttgatccaattgaacaggatgatgtttctagctatcttttggataaattcagatgtgtgccaacgtttcttccacctaatatcgtggaaaaatactatgagggattctgcaagaggcatttgtggccactttttcactacatgttaccattttcacctgaccatggaggccgctttgatcgttctatgtgggaagcatatgtttctgccaacaagatgttttcacagaaagtggttgaggtgcttaatcctgaggatgattttgtttggattcatgattatcatttgatggtgttgcccacgttcttgagaaggcggttcaatcgattgaggattgggtttttccttcacagtccatttccttcatctgagatttacaggacacttcctgttagagaggaaatacttaaggctcttctatgttctgaccttgttggattccacactttcgactatgctcgacatttcctttcgtgttgcagtcgaatgttgggtttagagtaccagtctaaaagaggttatataggattggaatattatggaaggacagtaggtatcaagattatgccagtagggatacatatgggtcatattgagtctatgaagaaaattgcagataaagagctgaagtttaaggagctcaaacaacaatttgaaggaaaaactgttctgcttggagttgatgacttggatattttcaaaggtatcaacttaaagcttctagcaatggagcacatgctcaaacagcaccccagttggcaagggcaggctgtgcttgttcagattgccaatcctatgaggggtaaaggaatagatttagaggaaatacaggctgagatacaggaaagctgcaagaggattaataagcaatttggcaagcctggatatgagcctatagtttatattgataggtccgtgtccagtagcgagcgtatggcttattatagtgttgctgaatgtgttgttgtcacagctgttagggatgggatgaacctgactccatatgaatacatcgtttgtcgacagggtgtatcgggtgcagaaacagattcaggtgtaggtgaacctgacaagagcatgctagttgtgtcagaattcattgggtgttctccttccttaagtggggcaatccgtattaatccatggaatgttgaggcaactgctgaggcaatgaatgaggctgtgtcaatggctgaacaagagaaacagctacgacatgagaagcattaccgttatgtcagcacccacgatgttgcttattggtcgagaagtttcttgcaagatatggagagaacttgtgctgatcactttaggaaaagatgctatggcattggtttaggctttgggtttagagttgtttccctagatcccaacttcaggaagctgtcaattgatgatattgtgaatgcttatatcaagtctaagagcagggccatattcctggactatgacggaactgtgatgccgcagaattctatcattaagtctcctagtgctaatgttatctccatcctgaataaactttctggtgatccaaacaacaccgtcttcattgttagtggaagagggagggaaagcctaaccaagtggttttctccttgtagaaaactaggacttgcagcagaacatggctactttttgagatgggaacgagaacagaaatgggaagtatgcagtcagacctctgattttgggtggatgcaacttgctgaacccgtgatgcaatcctatacagacgctacagatggttcttgcatagaaagaaaggaaagtgctatagtgtggcagtatcgtgatgcggattctggatttgggttttctcaggcaaaggagatgcttgatcatctggagagtgttttagcgaatgaaccggttgccgtgaaaagcggtcagcacattgtggaagtgaagcctcagggggtcaccaaaggtttagttgcagaaaaagtctttacatctttagcagtgaaaggaaaactggcggattttgtgctttgcattggtgatgatagatcagatgaagatatgtttgaaatcattggcgatgctttgtccagaaatattatttcatatgatgccaaggtatttgcttgcacagttggacaaaaacctagcaaagcaaagtattacttggatgacacatctgaggtggtgcttatgctagactcccttgctgatgccactgatactccagtgacttccgatgatgaacctgtggactccgactga

SEQ ID NO: 46 - protein, 857 aa, Solanum tuberosum
MMSRSYTNLLDLASGNFPVMGRERDRRRMSRVMTVPGSICELDDDQAVSVSSDNQSSLAGDRMIVVANQLPLKAKRRPDNKGWSFSWNEDSLLLRLKDGLPEDMEVLFVGSLSVDVDPIEQDDVSSYLLDKFRCVPTFLPPNIVEKYYEGFCKRHLWPLFHYMLPFSPDHGGRFDRSMWEAYVSANKMFSQKVVEVLNPEDDFVWIHDYHLMVLPTFLRRRFNRLRIGFFLHSPFPSSEIYRTLPVREEILKALLCSDLVGFHTFDYARHFLSCCSRMLGLEYQSKRGYIGLEYYGRTVGIKIMPVGIHMGHIESMKKIADKELKFKELKQQFEGKTVLLGVDDLDIFKGINLKLLAMEHMLKQHPSWQGQAVLVQIANPMRGKGIDLEEIQAEIQESCKRINKQFGKPGYEPIVYIDRSVSSSERMAYYSVAECVVVTAVRDGMNLTPYEYIVCRQGVSGAETDSGVGEPDKSMLVVSEFIGCSPSLSGAIRINPWNVEATAEAMNEAVSMAEQEKQLRHEKHYRYVSTHDVAYWSRSFLQDMERTCADHFRKRCYGIGLGFGFRVVSLDPNFRKLSIDDIVNAYIKSKSRAIFLDYDGTVMPQNSIIKSPSANVISILNKLSGDPNNTVFIVSGRGRESLTKWFSPCRKLGLAAEHGYFLRWEREQKWEVCSQTSDFGWMQLAEPVMQSYTDATDGSCIERKESAIVWQYRDADSGFGFSQAKEMLDHLESVLANEPVAVKSGQHIVEVKPQGVTKGLVAEKVFTSLAVKGKLADFVLCIGDDRSDEDMFEIIGDALSRNIISYDAKVFACTVGQKPSKAKYYLDDTSEVVLMLDSLADATDTPVTSDDEPVDSD

SEQ ID NO: 47 - DNA, 2544 bp, Arabidopsis thaliana
  CDS (1)..(2544)
atggtttcaagatcgtattcaaatctgttggagttagcttcaggagactcaccaacgtttggacgcatgaaccgacaaatcccacgaatcatggccgttgctggaatcatgtcaaacatcgataatgactctaaagacactgatctgtctcctaaagatcgtatcatcattgtagccaatgaattacctatacgagctcagagaagggttgatggtaatggttggaacttttcttgggatgagaattcacttcttctccaattgaaagatgggttaggagatgaagctattgaagttatctatgttggttgtttgaaagaagagattcctcttaatgagcaagaagaagtgtatcagattcttcttgagagtttcaagtgtgtgcctacgtttttgcctttggatttgtacactagatactaccatggattctgtaagcaacagctttggcctttgtttcattacatgttgccactttctcctgatcttggaggtaggtttgataggactttgtggcaagcttatgtctctgtgaacaagatttttgctgatagaattatggaggtgattaatcctgaggatgattttgtgtggatacatgattatcatttgatggttttgcctactttcttgaggaagaggtttaacagagtcaagcttggtttcttccttcatagtccatttccatcgtctgagatttacaaaactttgcctattcgtgaagagcttcttcgggctttgctaaactcggatttgatagggttccatacttttgactacgctaggcatttcttgtcttgttgtagtcgaatgcttggtcttacttatgaatctaagagaggatacattggacttgagtattatggtagaaccgtgagtatcaaaattctacctgttggaatccacatgggtcagcttcagtcggttttgagcttacccgagactgaaaggaaagtcggggaacttattgaacggtatggtcgaaaaggcaggacgatgctgcttggtgtggatgatatggacattttcaaagggattactttaaagctgttggctatggagcagctgcttatgcaacatcctgaatggcaagggaaggttgtgttggtgcagatagctaatccggcgagagggaaagggaaagatgttaaagagatgcaagctgagacgtattcaactgttaagcggattaatgaaacgtttgggagacccggttacgatcctatagtattgatcgatgcaccgttgaagttctatgaaagggttgcttattacgtagtagctgagtgttgtttggtgacagcggttagggatgggatgaatcttataccttatgagtacatagtttctcgtcaaggaaatgagaaactggacaaaattctgaagctggaggcgaataatcgtaacaagaaaagcatgctggtggtttctgagtttattggttgctctccatcgctaagcggagccattcgtgttaatccatggaatgttgatgcagtagctgatgcaatggatagtgcccttgaagtagctgaaccggagaagcagctaagacatgagaagcattacaagtatgtgagcacacatgatgttggctattgggctcgtagcttcctccaagatcttgagaggagttgtggtgagcatggacgaaggaggtgttggggaattgggtttggtctcagtttcagagttgtggcactagaccagagcttcaggaagctgtcaatggaacacatagtatcagcttataagaggacaaagacacgggctatccttttagactatgatgatactttaatgccacaaggctcgatcgataaaaggccttcatcgaagtcaatcgacatattgaacaccttgtgtagggacaagggcaatctggtgttcattgttagtgctaaaagccgagaaactctatcggactggtttagtccttgtgagaagcttggtattgctgctgaacatggctattttctgaggctaaggaaggcagtagagtgggaaaactgtgtggcagcagtagattgttcttggaagcaaattgccgagcctgtgatggaactctacaccgagacaaccgatggctcaacaattgaagacaaggagactgctcttgtttggagttatgaggatgctgaccctgattttggctcatgtcaagctaaggaacttctagatcatcttgaaagtgtccttgccaatgaacctgtaacagtgaaacgaggacagaactatgttgaggtcaagccacagggcgtgagcaagggacttatagcgagaaggatgctttcgatgatgcaagaaagaggaacacttcctgagtttgttctatgtattggagatgaccggtctgacgaagacatgtttgaggtgatctgcagttccactgaaggcccttcgattgccccaagagctgagattttcgcttgtactgtcggtcaaaagcctagcaaggccaagtattacctggatgacactactgagattgtcaggttaatgcatggtttagcttctgttacagaccagatcactcctgtttaa

SEQ ID NO: 48 - protein, 847 aa, Arabidopsis thaliana
MVSRSYSNLLELASGDSPTFGRMNRQIPRIMAVAGIMSNIDNDSKDTDLSPKDRIIIVANELPIRAQRRVDGNGWNFSWDENSLLLQLKDGLGDEAIEVIYVGCLKEEIPLNEQEEVYQILLESFKCVPTFLPLDLYTRYYHGFCKQQLWPLFHYMLPLSPDLGGRFDRTLWQAYVSVNKIFADRIMEVINPEDDFVWIHDYHLMVLPTFLRKRFNRVKLGFFLHSPFPSSEIYKTLPIREELLRALLNSDLIGFHTFDYARHFLSCCSRMLGLTYESKRGYIGLEYYGRTVSIKILPVGIHMGQLQSVLSLPETERKVGELIERYGRKGRTMLLGVDDMDIFKGITLKLLAMEQLLMQHPEWQGKVVLVQIANPARGKGKDVKEMQAETYSTVKRINETFGRPGYDPIVLIDAPLKFYERVAYYVVAECCLVTAVRDGMNLIPYEYIVSRQGNEKLDKILKLEANNRNKKSMLVVSEFIGCSPSLSGAIRVNPWNVDAVADAMDSALEVAEPEKQLRHEKHYKYVSTHDVGYWARSFLQDLERSCGEHGRRRCWGIGFGLSFRVVALDQSFRKLSMEHIVSAYKRTKTRAILLDYDDTLMPQGSIDKRPSSKSIDILNTLCRDKGNLVFIVSAKSRETLSDWFSPCEKLGIAAEHGYFLRLRKAVEWENCVAAVDCSWKQIAEPVMELYTETTDGSTIEDKETALVWSYEDADPDFGSCQAKELLDHLESVLANEPVTVKRGQNYVEVKPQGVSKGLIARRMLSMMQERGTLPEFVLCIGDDRSDEDMFEVICSSTEGPSIAPRAEIFACTVGQKPSKAKYYLDDTTEIVRLMHGLASVTDQITPV

SEQ ID NO: 49 - protein, 911 aa, Artificial sequence
  Description of artificial sequence: consensus sequence
  Variant (2)..(2): Xaa in position 2 is any amino acid
  Variant (4)..(4): Xaa in position 4 is any amino acid
  Variant (6)..(7): Xaa in position 6 to 7 is any amino acid
  Variant (9)..(9): Xaa in position 9 is any amino acid
  Variant (11)..(11): Xaa in position 11 is any amino acid
  Variant (13)..(27): Xaa in position 13 to 27 is any amino acid
  Variant (28)..(46): Xaa in position 28 to 46 is any or no amino acid
  Variant (48)..(60): Xaa in position 48 to 60 is any amino acid
  Variant (61)..(83): Xaa in position 61 to 83 is any or no amino acid
  Variant (85)..(85): Xaa in position 85 is any amino acid
  Variant (87)..(87): Xaa in position 87 is any amino acid
  Variant (89)..(89): Xaa in position 89 is any amino acid
  Variant (91)..(91): Xaa in position 91 is any amino acid
  Variant (94)..(104): Xaa in position 94 to 104 is any amino acid
  Variant (105)..(119): Xaa in position 105 to 119 is any or no amino acid
  Variant (121)..(122): Xaa in position 121 to 122 is any amino acid
  Variant (124)..(124): Xaa in position 124 is any amino acid
  Variant (128)..(130): Xaa in position 128 to 130 is any amino acid
  Variant (132)..(139): Xaa in position 132 to 139 is any amino acid
  Variant (140)..(145): Xaa in position 140 to 145 is any or no amino acid
  Variant (147)..(150): Xaa in position 147 to 150 is any amino acid
  Variant (152)..(152): Xaa in position 152 is any amino acid
  Variant (154)..(161): Xaa in position 154 to 161 is any amino acid
  Variant (162)..(163): Xaa in position 162 to 163 is any or no amino acid
  Variant (165)..(166): Xaa in position 165 to 166 is any amino acid
  Variant (168)..(170): Xaa in position 168 to 170 is any amino acid
  Variant (173)..(174): Xaa in position 173 to 174 is any amino acid
  Variant (176)..(176): Xaa in position 176 is any amino acid
  Variant (178)..(178): Xaa in position 178 is any amino acid
  Variant (180)..(180): Xaa in position 180 is any amino acid
  Variant (182)..(182): Xaa in position 182 is any amino acid
  Variant (184)..(190): Xaa in position 184 to 190 is any amino acid
  Variant (192)..(192): Xaa in position 192 is any amino acid
  Variant (197)..(198): Xaa in position 197 to 198 is any amino acid
  Variant (209)..(213): Xaa in position 209 to 213 is any amino acid
  Variant (214)..(232): Xaa in position 214 to 232 is any or no amino acid
  Variant (234)..(235): Xaa in position 234 to 235 is any amino acid
  Variant (239)..(240): Xaa in position 239 to 240 is any amino acid
  Variant (242)..(242): Xaa in position 242 is any amino acid
  Variant (245)..(247): Xaa in position 245 to 247 is any amino acid
  Variant (250)..(250): Xaa in position 250 is any amino acid
  Variant (252)..(256): Xaa in position 252 to 256 is any amino acid
  Variant (259)..(260): Xaa in position 259 to 260 is any amino acid
  Variant (262)..(262): Xaa in position 262 is any amino acid
  Variant (265)..(265): Xaa in position 265 is any amino acid
  Variant (268)..(268): Xaa in position 268 is any amino acid
  Variant (275)..(275): Xaa in position 275 is any amino acid
  Variant (282)..(282): Xaa in position 282 is any amino acid
  Variant (284)..(285): Xaa in position 284 to 285 is any amino acid
  Variant (287)..(289): Xaa in position 287 to 289 is any amino acid
  Variant (310)..(310): Xaa in position 310 is any amino acid
  Variant (312)..(312): Xaa in position 312 is any amino acid
  Variant (314)..(315): Xaa in position 314 to 315 is any amino acid
  Variant (319)..(319): Xaa in position 319 is any amino acid
  Variant (344)..(344): Xaa in position 344 is any amino acid
  Variant (346)..(346): Xaa in position 346 is any amino acid
  Variant (351)..(351): Xaa in position 351 is any amino acid
  Variant (355)..(355): Xaa in position 355 is any amino acid
  Variant (357)..(357): Xaa in position 357 is any amino acid
  Variant (362)..(363): Xaa in position 362 to 363 is any amino acid
  Variant (366)..(366): Xaa in position 366 is any amino acid
  Variant (370)..(370): Xaa in position 370 is any amino acid
  Variant (371)..(374): Xaa in position 371 to 374 is any or no amino acid
  Variant (376)..(387): Xaa in position 376 to 387 is any amino acid
  Variant (389)..(389): Xaa in position 389 is any amino acid
  Variant (391)..(401): Xaa in position 391 to 401 is any amino acid
  Variant (402)..(403): Xaa in position 402 to 403 is any or no amino acid
  Variant (416)..(416): Xaa in position 416 is any amino acid
  Variant (419)..(419): Xaa in position 419 is any amino acid
  Variant (422)..(422): Xaa in position 422 is any amino acid
  Variant (424)..(425): Xaa in position 424 to 425 is any amino acid
  Variant (427)..(429): Xaa in position 427 to 429 is any amino acid
  Variant (431)..(433): Xaa in position 431 to 433 is any amino acid
  Variant (435)..(436): Xaa in position 435 to 436 is any amino acid
  Variant (442)..(442): Xaa in position 442 is any amino acid
  Variant (447)..(448): Xaa in position 447 to 448 is any amino acid
  Variant (452)..(457): Xaa in position 452 to 457 is any amino acid
  Variant (459)..(464): Xaa in position 459 to 464 is any amino acid
  Variant (468)..(470): Xaa in position 468 to 470 is any amino acid
  Variant (472)..(474): Xaa in position 472 to 474 is any amino acid
  Variant (475)..(476): Xaa in position 475 to 476 is any or no amino acid
  Variant (478)..(478): Xaa in position 478 is any amino acid
  Variant (480)..(482): Xaa in position 480 to 482 is any amino acid
  Variant (485)..(490): Xaa in position 485 to 490 is any amino acid
  Variant (492)..(493): Xaa in position 492 to 493 is any amino acid
  Variant (497)..(498): Xaa in position 497 to 498 is any amino acid
  Variant (502)..(503): Xaa in position 502 to 503 is any amino acid
  Variant (505)..(505): Xaa in position 505 is any amino acid
  Variant (514)..(514): Xaa in position 514 is any amino acid
  Variant (517)..(517): Xaa in position 517 is any amino acid
  Variant (519)..(521): Xaa in position 519 to 521 is any amino acid
  Variant (525)..(534): Xaa in position 525 to 534 is any amino acid
  Variant (535)..(542): Xaa in position 535 to 542 is any or no amino acid
  Variant (544)..(544): Xaa in position 544 is any amino acid
  Variant (567)..(573): Xaa in position 567 to 573 is any amino acid
  Variant (575)..(577): Xaa in position 575 to 577 is any amino acid
  Variant (579)..(582): Xaa in position 579 to 582 is any amino acid
  Variant (584)..(584): Xaa in position 584 is any amino acid
  Variant (587)..(587): Xaa in position 587 is any amino acid
  Variant (594)..(595): Xaa in position 594 to 595 is any amino acid
  Variant (603)..(603): Xaa in position 603 is any amino acid
  Variant (606)..(607): Xaa in position 606 to 607 is any amino acid
  Variant (610)..(610): Xaa in position 610 is any amino acid
  Variant (616)..(616): Xaa in position 616 is any amino acid
  Variant (618)..(619): Xaa in position 618 to 619 is any amino acid
  Variant (621)..(623): Xaa in position 621 to 623 is any amino acid
  Variant (630)..(630): Xaa in position 630 is any amino acid
  Variant (632)..(632): Xaa in position 632 is any amino acid
  Variant (633)..(633): Xaa in position 633 is any or no amino acid
  Variant (637)..(638): Xaa in position 637 to 638 is any amino acid
  Variant (640)..(640): Xaa in position 640 is any amino acid
  Variant (642)..(642): Xaa in position 642 is any amino acid
  Variant (644)..(645): Xaa in position 644 to 645 is any amino acid
  Variant (647)..(650): Xaa in position 647 to 650 is any amino acid
  Variant (652)..(654): Xaa in position 652 to 654 is any amino acid
  Variant (656)..(660): Xaa in position 656 to 660 is any amino acid
  Variant (662)..(662): Xaa in position 662 is any amino acid
  Variant (664)..(664): Xaa in position 664 is any amino acid
  Variant (671)..(672): Xaa in position 671 to 672 is any amino acid
  Variant (674)..(674): Xaa in position 674 is any amino acid
  Variant (675)..(675): Xaa in position 675 is any or no amino acid
  Variant (678)..(680): Xaa in position 678 to 680 is any amino acid
  Variant (682)..(691): Xaa in position 682 to 691 is any amino acid
  Variant (693)..(694): Xaa in position 693 to 694 is any amino acid
  Variant (696)..(697): Xaa in position 696 to 697 is any amino acid
  Variant (699)..(699): Xaa in position 699 is any amino acid
  Variant (702)..(702): Xaa in position 702 is any amino acid
  Variant (706)..(710): Xaa in position 706 to 710 is any amino acid
  Variant (712)..(713): Xaa in position 712 to 713 is any amino acid
  Variant (715)..(716): Xaa in position 715 to 716 is any amino acid
  Variant (717)..(717): Xaa in position 717 is any or no amino acid
  Variant (719)..(720): Xaa in position 719 to 720 is any amino acid
  Variant (723)..(723): Xaa in position 723 is any amino acid
  Variant (731)..(731): Xaa in position 731 is any amino acid
  Variant (733)..(738): Xaa in position 733 to 738 is any amino acid
  Variant (740)..(749): Xaa in position 740 to 749 is any amino acid
  Variant (751)..(755): Xaa in position 751 to 755 is any amino acid
  Variant (759)..(760): Xaa in position 759 to 760 is any amino acid
  Variant (762)..(762): Xaa in position 762 is any amino acid
  Variant (764)..(764): Xaa in position 764 is any amino acid
  Variant (769)..(769): Xaa in position 769 is any amino acid
  Variant (772)..(772): Xaa in position 772 is any amino acid
  Variant (775)..(775): Xaa in position 775 is any amino acid
  Variant (780)..(783): Xaa in position 780 to 783 is any amino acid
  Variant (786)..(787): Xaa in position 786 to 787 is any amino acid
  Variant (791)..(791): Xaa in position 791 is any amino acid
  Variant (796)..(798): Xaa in position 796 to 798 is any amino acid
  Variant (805)..(805): Xaa in position 805 is any amino acid
  Variant (810)..(810): Xaa in position 810 is any amino acid
  Variant (813)..(813): Xaa in position 813 is any amino acid
  Variant (815)..(817): Xaa in position 815 to 817 is any amino acid
  Variant (826)..(826): Xaa in position 826 is any amino acid
  Variant (829)..(833): Xaa in position 829 to 833 is any amino acid
  Variant (834)..(846): Xaa in position 834 to 846 is any or no amino acid
  Variant (849)..(849): Xaa in position 849 is any amino acid
  Variant (850)..(850): Xaa in position 850 is any or no amino acid
  Variant (852)..(852): Xaa in position 852 is any amino acid
  Variant (863)..(864): Xaa in position 863 to 864 is any amino acid
  Variant (866)..(876): Xaa in position 866 to 876 is any amino acid
  Variant (877)..(881): Xaa in position 877 to 881 is any or no amino acid
  Variant (888)..(888): Xaa in position 888 is any amino acid
  Variant (900)..(909): Xaa in position 900 to 909 is any amino acid
MXSXSXXNXLXLXXXXXXXXXXXXXXXXXXXXXXXXXXXXXXXXXXRXXXXXXXXXXXXXXXXXXXXXXXXXXXXXXXXXXXXRXIXVXNXLPXXXXXXXXXXXXXXXXXXXXXXXXXXFXXDXDSLXXXLXXXXXXXXXXXXXXEXXXXGXLXXXXXXXXXXQXXVXXXLLXXFXCXPXFXPXXXXXXXYXGFCKXXLWPLFHYMLPXXXXXXXXXXXXXXXXXXXXXXXXGXXFDRXXWXAYXXXNKXFXXXXXEVXXPXDDXVWXHDYHLMXLPTFLRXRXXRXXXGFFLHSPFPSSEIYRTLPVRXEXLXXLLNXDLIGFHTFDYARHFLSCCSRMLGLXYXSKRGXIGLXYXGRTVXXKIXPVGXXXXXLXXXXXXXXXXXXVXEXXXXXXXXXXXXXLGVDDMDIFKGIXLKXLAXEXXLXXXPXXXGXXVLVQIXNPARXXGKDXXXXXXEXXXXXXRINXXXGXXXXXYXPXXXIDXXXXXXEXXAYYXXAECXXVXAVRDGMNLXPYXYXXXRQGXXXXXXXXXXXXXXXXXXSXLVVSEFIGCSPSLSGAIRVNPWXXXXXXXAXXXAXXXXEXEKXLRHEKHXXYVSTHDVXYWXXSFXQDLERXCXXHXXXRCWGIGXGXXFRVXXLXPXFXXLXXXXIXXXYXXXXXRXIXLDYDGTXXPXXSIXXXPXXXXXXXXXXLXXDXXNXVFXVSGXXXXXLXXWXXXCXXLGXAAEHGYFXRXXXXXXWXXXXXXXXXXWXXXXXPVMXXYXEXTDGSXIEXKEXALVWXXXXADXXFGSXQAKEXXXHLESVLXNEPVXVKXGXXXVEVKPQGVXKGXXXXXXXXXXXXXXXXXXDFXXCXGDDRSDEDMFXXIXXXXXXXXXXXXXXXXFACTVGXKPSKAKYYLDDXXXXXXXXXXLA

SEQ ID NO: 50 - protein, 60 aa, Artificial sequence
  Description of artificial sequence: amino acid sequence pattern comprised in a variant of SEQ ID NO:2
  Variant (2)..(2): Xaa in position 2 is any amino acid
  Variant (15)..(15): Xaa in position 15 is Lys or Arg
  Variant (16)..(16): Xaa in position 16 is Ser or Thr
  Variant (19)..(19): Xaa in position 19 is Ile or Val
  Variant (21)..(22): Xaa in position 21 to 22 is any amino acid
  Variant (23)..(23): Xaa in position 23 is any or no amino acid
  Variant (25)..(25): Xaa in position 25 is Lys or Arg
  Variant (26)..(26): Xaa in position 26 is Ala, Gly, Ser or Thr
  Variant (27)..(27): Xaa in position 27 is Phe or Leu
  Variant (29)..(30): Xaa in position 29 to 30 is any amino acid
  Variant (33)..(33): Xaa in position 33 is Ile or Val
  Variant (36)..(36): Xaa in position 36 is any amino acid
  Variant (45)..(45): Xaa in position 45 is any amino acid
  Variant (46)..(46): Xaa in position 46 is Ser or Thr
  Variant (49)..(49): Xaa in position 49 is Cys, Gly or Ser
  Variant (51)..(51): Xaa in position 51 is Leu or Met
  Variant (54)..(54): Xaa in position 54 is Ile or Leu
  Variant (55)..(55): Xaa in position 55 is any amino acid
  Variant (57)..(57): Xaa in position 57 is Glu or Gln
  Variant (59)..(59): Xaa in position 59 is any amino acid
GXFLHSPFPSSEIYXXLPXRXXXLXXXLXXDLXGFXTFDYARHFXXCCXRXLGXXYXSXR

SEQ ID NO: 51 - protein, 58 aa, Artificial sequence
  Description of artificial sequence: amino acid sequence pattern comprised in a variant of SEQ ID NO: 2
  Variant (14)..(14): Xaa in position 14 is Ile or Val
  Variant (16)..(16): Xaa in position 16 is Ile or Val
  Variant (20)..(20): Xaa in position 20 is Asp or Asn
  Variant (21)..(21): Xaa in position 21 is Ile or Val
  Variant (22)..(22): Xaa in position 22 is Asp or Glu
  Variant (23)..(23): Xaa in position 23 is Ala, Asp or Thr
  Variant (24)..(24): Xaa in position 24 is Thr or Val
  Variant (25)..(25): Xaa in position 25 is Ala, Gly, Ser or Thr
  Variant (26)..(26): Xaa in position 26 is Asp, Glu or Asn
  Variant (27)..(27): Xaa in position 27 is any amino acid
  Variant (28)..(28): Xaa in position 28 is Leu, Met or Val
  Variant (29)..(30): Xaa in position 29 to 30 is any amino acid
  Variant (31)..(31): Xaa in position 31 is Ala or Ser
  Variant (32)..(32): Xaa in position 32 is Ile, Leu, Met or Val
  Variant (33)..(33): Xaa in position 33 is any amino acid
  Variant (34)..(34): Xaa in position 34 is Leu, Met or Val
  Variant (35)..(35): Xaa in position 35 is any amino acid
  Variant (36)..(36): Xaa in position 36 is Asp or Glu
  Variant (37)..(37): Xaa in position 37 is any amino acid
  Variant (40)..(40): Xaa in position 40 is any amino acid
  Variant (41)..(41): Xaa in position 41 is Leu or Met
  Variant (44)..(44): Xaa in position 44 is any amino acid
  Variant (46)..(46): Xaa in position 46 is any amino acid
  Variant (47)..(47): Xaa in position 47 is Phe, His or Tyr
  Variant (48)..(48): Xaa in position 48 is His, Lys or Arg
  Variant (50)..(50): Xaa in position 50 is Ile or Val
  Variant (51)..(51): Xaa in position 51 is Asp or Ser
  Variant (52)..(52): Xaa in position 52 is Ser or Thr
  Variant (54)..(54): Xaa in position 54 is Asp or Asn
  Variant (56)..(56): Xaa in position 56 is Ala or Gly
SEFIGCSPSLSGAXRXNPWXXXXXXXXXXXXXXXXXXEKXXRHXKXXXYXXXHXVXYW

SEQ ID NO: 52 - protein, 62 aa, Artificial sequence
  Description of artificial sequence: amino acid sequence pattern comprised in a variant of SEQ ID NO: 2
  Variant (4)..(4): Xaa in position 4 is Ser or Thr
  Variant (5)..(5): Xaa in position 5 is any amino acid
  Variant (6)..(6): Xaa in position 6 is Ile or Val
  Variant (7)..(7): Xaa in position 7 is Asp or Glu
  Variant (8)..(8): Xaa in position 8 is any amino acid
  Variant (11)..(11): Xaa in position 11 is Gly, Ser or Thr
  Variant (12)..(12): Xaa in position 12 is Ala or Gly
  Variant (13)..(13): Xaa in position 13 is Ile or Leu
  Variant (16)..(18): Xaa in position 16 to 18 is any amino acid
  Variant (19)..(20): Xaa in position 19 to 20 is any or no amino acid
  Variant (22)..(22): Xaa in position 22 is Ala or Pro
  Variant (24)..(25): Xaa in position 24 to 25 is any or no amino acid
  Variant (28)..(29): Xaa in position 28 to 29 is any amino acid
  Variant (34)..(34): Xaa in position 34 is Leu or Met
  Variant (35)..(35): Xaa in position 35 is any amino acid
  Variant (36)..(36): Xaa in position 36 is Asp, Glu or Gly
  Variant (40)..(40): Xaa in position 40 is any amino acid
  Variant (43)..(43): Xaa in position 43 is Ala, Ser, Thr or Val
  Variant (45)..(45): Xaa in position 45 is Asp or Glu
  Variant (47)..(47): Xaa in position 47 is Ala or Val
  Variant (48)..(48): Xaa in position 48 is any amino acid
  Variant (50)..(51): Xaa in position 50 to 51 is any amino acid
  Variant (53)..(55): Xaa in position 53 to 55 is any amino acid
TDGXXXXXKEXXXVWXXXXXDXDXXFGXXQAKEXXXHLEXVLXNXPXXVXXGXXXVEVKPQG

SEQ ID NO: 53 - protein, 56 aa, Artificial sequence
  Description of artificial sequence: amino acid sequence pattern comprised in a variant of SEQ ID NO: 2
  Variant (4)..(5): Xaa in position 4 to 5 is any amino acid
  Variant (6)..(6): Xaa in position 6 is Phe or Trp
  Variant (7)..(7): Xaa in position 7 is Glu, Gln or Arg
  Variant (8)..(8): Xaa in position 8 is Ala or Ser
  Variant (10)..(11): Xaa in position 10 to 11 is any or no amino acid
  Variant (13)..(14): Xaa in position 13 to 14 is any or no amino acid
  Variant (17)..(17): Xaa in position 17 is any amino acid
  Variant (19)..(19): Xaa in position 19 is any amino acid
  Variant (20)..(20): Xaa in position 20 is Asp, Glu or Gln
  Variant (21)..(21): Xaa in position 21 is Lys or Arg
  Variant (22)..(22): Xaa in position 22 is Ile or Val
  Variant (23)..(23): Xaa in position 23 is Phe, Ile, Leu, Met or Val
  Variant (25)..(25): Xaa in position 25 is Ala or Val
  Variant (26)..(26): Xaa in position 26 is Ile or Leu
  Variant (27)..(27): Xaa in position 27 is Asn or Ser
  Variant (28)..(28): Xaa in position 28 is Pro or Thr
  Variant (29)..(30): Xaa in position 29 to 30 is Asp or Glu
  Variant (32)..(32): Xaa in position 32 is Phe, His or Tyr
  Variant (35)..(35): Xaa in position 35 is Ile or Val
  Variant (36)..(36): Xaa in position 36 is any amino acid
  Variant (41)..(41): Xaa in position 41 is Ile or Met
  Variant (42)..(42): Xaa in position 42 is Ala, Ile, Leu or Val
  Variant (49)..(49): Xaa in position 49 is any amino acid
  Variant (50)..(50): Xaa in position 50 is His or Arg
  Variant (51)..(52): Xaa in position 51 to 52 is any amino acid
  Variant (54)..(54): Xaa in position 54 is Ile, Leu or Val
  Variant (55)..(55): Xaa in position 55 is Lys or Arg
  Variant (56)..(56): Xaa in position 56 is Ile, Leu or Met
FDRXXXXXYXXVXXNKXFXXXXXEXXXXXXDXVWXXDYHLXXLPTFLRXXXXRXXX

SEQ ID NO: 54 - protein, 46 aa, Artificial sequence
  Description of artificial sequence: amino acid sequence pattern comprised in a variant of SEQ ID NO: 2
  Variant (2)..(2): Xaa in position 2 is Ile or Val
  Variant (3)..(3): Xaa in position 3 is Phe, Ile or Val
  Variant (4)..(4): Xaa in position 4 is any amino acid
  Variant (6)..(6): Xaa in position 6 is Asp or Asn
  Variant (7)..(8): Xaa in position 7 to 8 is any amino acid
  Variant (9)..(9): Xaa in position 9 is Ile, Leu or Val
  Variant (10)..(15): Xaa in position 10 to 15 is any amino acid
  Variant (17)..(17): Xaa in position 17 is Phe or Tyr
  Variant (19)..(20): Xaa in position 19 to 20 is any amino acid
  Variant (21)..(21): Xaa in position 21 is Ala or Ser
  Variant (22)..(22): Xaa in position 22 is Asp or Glu
  Variant (24)..(24): Xaa in position 24 is Cys or Val
  Variant (25)..(25): Xaa in position 25 is Ile, Leu or Val
  Variant (27)..(27): Xaa in position 27 is Asn or Thr
  Variant (36)..(36): Xaa in position 36 is any amino acid
  Variant (39)..(39): Xaa in position 39 is Glu or Lys
  Variant (41)..(41): Xaa in position 41 is any amino acid
  Variant (42)..(42): Xaa in position 42 is Ala, Ile or Val
  Variant (43)..(43): Xaa in position 43 is Ala, Cys, Ser or Thr
  Variant (45)..(45): Xaa in position 45 is Glu or Gln
  Variant (46)..(46): Xaa in position 46 is Ala or Gly
PXXXIXXXXXXXXXXAXYXXXXCXXVXAVRDGMNLXPYXYXXXRXX

SEQ ID NO: 55 - protein, 38 aa, Artificial sequence
  Description of artificial sequence: amino acid sequence pattern comprised in a variant of SEQ ID NO: 2
  Variant (2)..(3): Xaa in position 2 to 3 is any or no amino acid
  Variant (5)..(5): Xaa in position 5 is Ile, Leu or Val
  Variant (6)..(6): Xaa in position 6 is Ala or Ser
  Variant (8)..(8): Xaa in position 8 is Asp or Ser
  Variant (9)..(10): Xaa in position 9 to 10 is any amino acid
  Variant (12)..(12): Xaa in position 12 is any amino acid
  Variant (13)..(13): Xaa in position 13 is Lys or Arg
  Variant (15)..(15): Xaa in position 15 is Ala, Asn, Ser or Thr
  Variant (16)..(16): Xaa in position 16 is any amino acid
  Variant (17)..(17): Xaa in position 17 is Asp, Glu or Pro
  Variant (18)..(18): Xaa in position 18 is any amino acid
  Variant (19)..(19): Xaa in position 19 is Phe, Ile or Leu
  Variant (20)..(21): Xaa in position 20 to 21 is any amino acid
  Variant (22)..(22): Xaa in position 22 is Ala, Asp, Ser, Thr or Val
  Variant (24)..(25): Xaa in position 24 to 25 is any amino acid
  Variant (26)..(26): Xaa in position 26 is Ala, Ser or Thr
  Variant (27)..(28): Xaa in position 27 to 28 is any amino acid
  Variant (30)..(30): Xaa in position 30 is Ala, Ile or Val
  Variant (32)..(32): Xaa in position 32 is Phe or Leu
  Variant (33)..(33): Xaa in position 33 is Leu or Val
  Variant (37)..(37): Xaa in position 37 is Asp or Gly
RXXVXXLXXXFXXLXXXXXXXXYXXXXXRXIXXDYDXT

SEQ ID NO: 56 - protein, 26 aa, Artificial sequence
  Description of artificial sequence: amino acid sequence pattern comprised in a variant of SEQ ID NO: 2
  Variant (2)..(2): Xaa in position 2 is any amino acid
  Variant (3)..(4): Xaa in position 3 to 4 is any or no amino acid
  Variant (6)..(6): Xaa in position 6 is Ile or Val
  Variant (9)..(9): Xaa in position 9 is Leu, Met or Val
  Variant (11)..(11): Xaa in position 11 is Ile or Leu
  Variant (16)..(16): Xaa in position 16 is Gly, Asn, Ser or Thr
  Variant (19)..(19): Xaa in position 19 is any or no amino acid
  Variant (21)..(21): Xaa in position 21 is Ala, Ile or Leu
  Variant (22)..(23): Xaa in position 22 to 23 is any amino acid
  Variant (24)..(24): Xaa in position 24 is Glu, Asn or Gln
  Variant (25)..(25): Xaa in position 25 is any amino acid
  Variant (26)..(26): Xaa in position 26 is Leu or Met
LXXXGXDDXDXFKGIXLKXLXXXXXX

SEQ ID NO: 57 - protein, 24 aa, Artificial sequence
  Description of artificial sequence: amino acid sequence pattern comprised in a variant of SEQ ID NO: 2
  Variant (2)..(2): Xaa in position 2 is Asp, Glu, Pro or Gln
  Variant (3)..(3): Xaa in position 3 is any amino acid
  Variant (6)..(6): Xaa in position 6 is any amino acid
  Variant (7)..(7): Xaa in position 7 is any or no amino acid
  Variant (9)..(9): Xaa in position 9 is any or no amino acid
  Variant (15)..(15): Xaa in position 15 is any amino acid
  Variant (17)..(22): Xaa in position 17 to 22 is any amino acid
  Variant (24)..(24): Xaa in position 24 is Glu, Gln or Thr
CXXLGXXAXEHGYFXRXXXXXXWX

SEQ ID NO: 58 - protein, 40 aa, Artificial sequence
  Description of artificial sequence: amino acid sequence pattern comprised in a variant of SEQ ID NO: 2
  Variant (2)..(2): Xaa in position 2 is Lys or Arg
  Variant (3)..(3): Xaa in position 3 is Ala, Ile, Leu or Val
  Variant (6)..(6): Xaa in position 6 is Ile or Val
  Variant (8)..(8): Xaa in position 8 is Ile or Val
  Variant (9)..(9): Xaa in position 9 is Ala, Thr or Val
  Variant (14)..(15): Xaa in position 14 to 15 is any or no amino acid
  Variant (17)..(17): Xaa in position 17 is any amino acid
  Variant (18)..(19): Xaa in position 18 to 19 is any or no amino acid
  Variant (21)..(21): Xaa in position 21 is Ile, Leu or Val
  Variant (22)..(22): Xaa in position 22 is any amino acid
  Variant (23)..(23): Xaa in position 23 is Ala, Asp or Glu
  Variant (24)..(26): Xaa in position 24 to 26 is any amino acid
  Variant (27)..(27): Xaa in position 27 is Glu or Gln
  Variant (28)..(31): Xaa in position 28 to 31 is any amino acid
  Variant (32)..(32): Xaa in position 32 is Ala, Cys, Ser or Val
  Variant (33)..(33): Xaa in position 33 is any amino acid
  Variant (34)..(34): Xaa in position 34 is Glu, Lys or Arg
  Variant (35)..(35): Xaa in position 35 is Ile or Val
  Variant (37)..(38): Xaa in position 37 to 38 is any amino acid
  Variant (39)..(39): Xaa in position 39 is Phe or Tyr
GXXVLXQXXNPARXXGXXXDXXXXXXXXXXXXXXXNXXXG

SEQ ID NO: 59 - protein, 41 aa, Artificial sequence
  Description of artificial sequence: amino acid sequence pattern comprised in a variant of SEQ ID NO: 2
  Variant (2)..(2): Xaa in position 2 is any or no amino acid
  Variant (5)..(5): Xaa in position 5 is Ile, Leu or Val
  Variant (6)..(6): Xaa in position 6 is Asp or Glu
  Variant (8)..(8): Xaa in position 8 is Phe or Tyr
  Variant (11)..(11): Xaa in position 11 is Asn or Thr
  Variant (13)..(13): Xaa in position 13 is any amino acid
  Variant (14)..(14): Xaa in position 14 is Ile, Leu or Val
  Variant (17)..(17): Xaa in position 17 is Leu or Met
  Variant (18)..(18): Xaa in position 18 is Pro or Ser
  Variant (21)..(21): Xaa in position 21 is Ile or Val
  Variant (22)..(23): Xaa in position 22 to 23 is any amino acid
  Variant (24)..(24): Xaa in position 24 is Gly, Ser or Thr
  Variant (25)..(25): Xaa in position 25 is any amino acid
  Variant (26)..(26): Xaa in position 26 is Ile or Leu
  Variant (27)..(40): Xaa in position 27 to 40 is any amino acid
  Variant (41)..(41): Xaa in position 41 is Asp, Glu or Arg
GXIGXXYXGRXVXXKIXXVGXXXXXXXXXXXXXXXXXXXXX

SEQ ID NO: 60 - protein, 30 aa, Artificial sequence
  Description of artificial sequence: amino acid sequence pattern comprised in a variant of SEQ ID NO: 2
  Variant (4)..(4): Xaa in position 4 is Ser or Thr
  Variant (7)..(7): Xaa in position 7 is Gln or Arg
  Variant (13)..(13): Xaa in position 13 is any amino acid
  Variant (14)..(14): Xaa in position 14 is any or no amino acid
  Variant (16)..(17): Xaa in position 16 to 17 is any amino acid
  Variant (19)..(19): Xaa in position 19 is Asp, Glu or Thr
  Variant (20)..(20): Xaa in position 20 is any amino acid
  Variant (21)..(21): Xaa in position 21 is Ala, Asp, Glu, Gly, Ser or Thr
  Variant (22)..(25): Xaa in position 22 to 25 is any amino acid
  Variant (27)..(29): Xaa in position 27 to 29 is any or no amino acid
FACXVGXKPSKAXXYXXDXXXXXXXLXXXL

SEQ ID NO: 61 - protein, 22 aa, Artificial sequence
  Description of artificial sequence: amino acid sequence pattern comprised in a variant of SEQ ID NO: 2
  Variant (3)..(3): Xaa in position 3 is Asp, Glu or Gln
  Variant (5)..(5): Xaa in position 5 is Ala, Ser or Thr
  Variant (7)..(7): Xaa in position 7 is any amino acid
  Variant (8)..(8): Xaa in position 8 is Asp or Glu
  Variant (10)..(10): Xaa in position 10 is any amino acid
  Variant (11)..(12): Xaa in position 11 to 12 is any or no amino acid
  Variant (14)..(14): Xaa in position 14 is any amino acid
  Variant (15)..(16): Xaa in position 15 to 16 is any or no amino acid
  Variant (18)..(18): Xaa in position 18 is Ala or Gly
  Variant (19)..(19): Xaa in position 19 is Ile or Val
  Variant (21)..(21): Xaa in position 21 is Phe or Leu
DLXRXCXXHXXXRXXXWXXGXG

SEQ ID NO: 62 - protein, 26 aa, Artificial sequence
  Description of artificial sequence: amino acid sequence pattern comprised in a variant of SEQ ID NO: 2
  Variant (2)..(2): Xaa in position 2 is Phe, Ile or Leu
  Variant (3)..(5): Xaa in position 3 to 5 is any amino acid
  Variant (7)..(7): Xaa in position 7 is Gly, Asn, Ser or Thr
  Variant (8)..(10): Xaa in position 8 to 10 is any amino acid
  Variant (11)..(11): Xaa in position 11 is Ile, Leu or Val
  Variant (12)..(13): Xaa in position 12 to 13 is any amino acid
  Variant (14)..(14): Xaa in position 14 is Ile or Leu
  Variant (15)..(16): Xaa in position 15 to 16 is any amino acid
  Variant (18)..(18): Xaa in position 18 is Cys or Ser
  Variant (19)..(19): Xaa in position 19 is any amino acid
  Variant (21)..(22): Xaa in position 21 to 22 is any amino acid
  Variant (24)..(24): Xaa in position 24 is any amino acid
  Variant (25)..(25): Xaa in position 25 is Ile or Val
  Variant (26)..(26): Xaa in position 26 is Phe or Tyr
SXXXXPXXXXXXXXXXLXXDXXNXXX

SEQ ID NO: 63 - DNA, 1221 bp, Arabidopsis thaliana
  CDS (1)..(1221)
atgtctgcgatactccaaggagctggagctgcaacggctctctcgccgtttaattctatcgattccaacaaactcgttgctccttctcgctcttctctttcagtgaggagcaagagatacattgttgccggatctgatagtaaaagctttggttctagcctcgtagctcgtcgctctgagccgttgataccaaatgctgttacgacgaaggcggacactgctgcgagctctacttcatcaaagcctggacatgagctattacttttcgaggctcttcaagaaggtctagaagaagagatggacagagatccacatgtatgtgtcatgggtgaagatgtaggccattacggaggctcatacaaagtaactaaaggcctagctgataagtttggcgatctcagggttctggacactccaatctgtgaaaacgccttcaccggtatgggcattggagccgccatgacaggactaagacccgtcatcgaaggtatgaacatggggtttctactcttagccttcaaccaaatctccaacaactgtggtatgcttcactatacatccggtggtcaattcactatcccggttgttatccgtgggcctggaggtgtgggccggcagctcggagccgagcattcccagcgtctcgagtcttacttccagtcaatccctgggatccagatggtggcttgctcaacaccttacaacgctaaaggattgatgaaagcggcgataagaagtgagaatcctgtgattctgtttgaacacgttctgctctataacctcaaggagagtattccggatgaagaatacatatgtaatctggaagaagcagaaatggtcagacccggtgaacacatcacgatactgacgtattcaaggatgaggtaccatgtaatgcaggctgcaaagacgctggtgaacaaagggtatgatccagaggttatcgacataaggtcgttgaagccgtttgatctctacacaattggaaactcggtgaagaagacacaccgggttttgattgtggaggaatgtatgagaacgggaggaatcggagccagtttgacggctgcaataaacgagaactttcatgattacttagatgctccggtgatgtgtttgtcttctcaggatgtcccaactccttacgccggtacattggaagaatggacggttgttcagccagctcagatcgtcactgccgtcgaacaactttgccagtaa

SEQ ID NO: 64 - protein, 406 aa, Arabidopsis thaliana
MSAILQGAGAATALSPFNSIDSNKLVAPSRSSLSVRSKRYIVAGSDSKSFGSSLVARRSEPLIPNAVTTKADTAASSTSSKPGHELLLFEALQEGLEEEMDRDPHVCVMGEDVGHYGGSYKVTKGLADKFGDLRVLDTPICENAFTGMGIGAAMTGLRPVIEGMNMGFLLLAFNQISNNCGMLHYTSGGQFTIPVVIRGPGGVGRQLGAEHSQRLESYFQSIPGIQMVACSTPYNAKGLMKAAIRSENPVILFEHVLLYNLKESIPDEEYICNLEEAEMVRPGEHITILTYSRMRYHVMQAAKTLVNKGYDPEVIDIRSLKPFDLYTIGNSVKKTHRVLIVEECMRTGGIGASLTAAINENFHDYLDAPVMCLSSQDVPTPYAGTLEEWTVVQPAQIVTAVEQLCQ

SEQ ID NO: 65 - DNA, 1560 bp, Glycine max
  CDS (126)..(1337)
accaaattgtgttctttaatttctccgcccattgcattttgcatttccgctcctataaataaattcccattctttccgtctgtatcttcattttcatttccatctttcttgggtgatacgatccaatggctgcgacccttttccagggattgggagttgtgaccccatcattctcttcttcccactccaacaagttcatgctttcttccctctcagagaggaaagatggcatatttgtggtcagatctgatgctgatgcaaggattctgaagactggagctcgtaagcatgaattgttggttactaatgcagttgcaacaaagggagccagttctgcggcctctacatcaaaatctggatctgggcatgaacttctcctttttgaggccctacgcgaaggtttggaggaagaaatggagagggatccttgtgtatgtgtcatgggtgaagatgtaggtcattatggaggatcttataaggtgactaaaggccttgccccaaagtttggggaccttagagttttggacacccctattgctgagaacgcctttatggggatgggcattggagctgccatgactggtctgaggccagttgttgagggcatgaacatgggatttctacttctggcatttaaccagatctctaacaattgtggcatgctgcattacacatcaggagggcagttcaaaataccaattgtcattcgtggacctggtggagttgggcggcaacttggagcagagcactcgcagcgattggagtcttattttcagtcaatccccggaatccagatggtggcttgctcaaccccttacaacgccaagggcttgatgaaagctgcaatccgaagtgagaaccccgtgattctctttgagcatgttttgctttataacctcaaggagagaattccagatgaagagtatgtattgtcacttgaagaagccgagatggttaggcctggggaacatgtcacgatattaacctattccaggatgaggtatcatgtcatgcaagctgccaagacactggtgaacaaggggtacgaccccgaagtaatcgatatcaggtctttgaaaccgtttgatcttcacacaatcgggaattcggtgaagaagacacaccgtgtgctaattgtggaagagtgcatgcggacgggtggaattggtgctagtttgacggctgccattaccgaaaatttccatgaccatttggatgctcctatagtatgcttatcctctcaggatgtgccgactccttatgctggaacattggaggaatggacagtagttcaacctgctcagattgtgactgcagttgagcaactctgccagtaattgctacaaaacactaccaattgtgcttgttaaattaagctagaaatttttatcatggttttctctttaccttttatttctgaagtctaaagcccataaatttcaattgttatttaacttctgttaaactttgcaaaaaaaaataaattattaaaagaagaatatagtagctatggaattgcactgctgctaaatattcacctgcacaagacaaaccagctgt

SEQ ID NO: 66 - protein, 403 aa, Glycine max
MAATLFQGLGVVTPSFSSSHSNKFMLSSLSERKDGIFVVRSDADARILKTGARKHELLVTNAVATKGASSAASTSKSGSGHELLLFEALREGLEEEMERDPCVCVMGEDVGHYGGSYKVTKGLAPKFGDLRVLDTPIAENAFMGMGIGAAMTGLRPVVEGMNMGFLLLAFNQISNNCGMLHYTSGGQFKIPIVIRGPGGVGRQLGAEHSQRLESYFQSIPGIQMVACSTPYNAKGLMKAAIRSENPVILFEHVLLYNLKERIPDEEYVLSLEEAEMVRPGEHVTILTYSRMRYHVMQAAKTLVNKGYDPEVIDIRSLKPFDLHTIGNSVKKTHRVLIVEECMRTGGIGASLTAAITENFHDHLDAPIVCLSSQDVPTPYAGTLEEWTVVQPAQIVTAVEQLCQ

SEQ ID NO: 67 - DNA, 2007 bp, Glycine max
  CDS (442)..(1659)
cggacgcgtgggcggacgcgtgggtttttgttcgtccctgtatgttcaagatttctcacatctcggcctcattatttgtttagatccggattagagaatccgtaagtgtttgtgtttattccggactgtgcgttccgtaacatggaggtgcatgtcgaaattggtgaggtgcaggaagcaacgaccccactataaacggggttaagtccaatcagagaaggcaaaggcatcatcggtgatggaaactatgctcacaagtgacagagtagaagcaaaagattttaattttagtaataactaacataataaactaggtgaacgtaactgcacagacacaactactacataaatcttaccttaatttctccgcccacttccctcctataaataaatcttccattctctctcttcatttcatctccatctttcttgggtgatccaatggcgacccttttccagggattgggagttgtgaacccatcattgtcttcttccaactccaacaacttcctgctttcttctcgtacatccctctctgagagaaaagatggcatatttgtagtcagatctgatgcaagggtaagcagcaaggttctgaaggccggagctcgcaagcatgaattgttagttactaatgcagtcgcaacaaaggaaggcagtcctgcggcttctacatcaaaatctgggcatgaacttctcctttttgaggccctacgtgaaggtttggaagaagaaatggagagggatccttgtgtatgtgtcatgggcgaagatgtaggtcactatggaggatcctacaaggtgactaaaggtcttgccacaaagtttggggaccttagagttttggacacccctattgctgagaactccttcacgggcatgggcattggggctgccatgactggtctgaggccagttgttgagggcatgaacatgggattcctacttctggcatttaaccagatctctaacaattgtggcatgctccattacacatctggaggccagttcaagataccaatcgtcattcgtggacctggtggagttgggcggcaacttggagcagaacactcgcagcgattggagtcgtattttcagtcaatccctggaatccagatggtggcttgctcaaccccttacaatgccaagggcttgatgaaagctgcaatccggagtgagaaccctgtgattcttttcgagcatgttttgctttataacctcaaggagagaattccagatgaagagtatgtattgtcacttgaagaagctgagatggttaggcctggggagcatgttacaatattaacgtactccaggatgaggtatcatgtcatgcaagctgctaagacactggtgaacaaggggtatgaccctgaagtaattgatatcaggtctttgaaaccattcgatcttcacacaattgggaattcggtgaagaagacacatcgtgtgctaattgtggaagagtgtatgcgaacgggtggaattggtgctagtttgacagctgctattactgaaaatttccatgactatttggatgcccctatagtatgtttatcctctcaggatgtgccaactccttatgctggaacattggaggaatggacagtggttcaacctgctcaaattgtgactgcagtcgagcagctctgcaagtgatttctacaaaacactagcaattaggatatggtttttggtaaagctattgtgcttgttaaattaagcttgaattttcattataattttctcttttcctattatttctgaagtctaaagcccataactttaaattgttgtttaatttctgatattctttgcgtttttttttttataaaaagagtatttagaactgccaacccaatctaaatctttctcagcttgttcatctgcataatttatgtggtgtgtgtgtaagagttaggccaagccttataactagggagatatttgtagtcagtgctgaactgctgaagcaagcaaatatctgttataaaccttgtttattct

SEQ ID NO: 68 - protein, 405 aa, Glycine max
MATLFQGLGVVNPSLSSSNSNNFLLSSRTSLSERKDGIFVVRSDARVSSKVLKAGARKHELLVTNAVATKEGSPAASTSKSGHELLLFEALREGLEEEMERDPCVCVMGEDVGHYGGSYKVTKGLATKFGDLRVLDTPIAENSFTGMGIGAAMTGLRPVVEGMNMGFLLLAFNQISNNCGMLHYTSGGQFKIPIVIRGPGGVGRQLGAEHSQRLESYFQSIPGIQMVACSTPYNAKGLMKAAIRSENPVILFEHVLLYNLKERIPDEEYVLSLEEAEMVRPGEHVTILTYSRMRYHVMQAAKTLVNKGYDPEVIDIRSLKPFDLHTIGNSVKKTHRVLIVEECMRTGGIGASLTAAITENFHDYLDAPIVCLSSQDVPTPYAGTLEEWTVVQPAQIVTAVEQLCK

SEQ ID NO: 69 - DNA, 1560 bp, Glycine max; identical to SEQ ID NO: 65
  CDS (198)..(1337)

SEQ ID NO: 70 - protein, 379 aa, Glycine max
MLSSLSERKDGIFVVRSDADARILKTGARKHELLVTNAVATKGASSAASTSKSGSGHELLLFEALREGLEEEMERDPCVCVMGEDVGHYGGSYKVTKGLAPKFGDLRVLDTPIAENAFMGMGIGAAMTGLRPVVEGMNMGFLLLAFNQISNNCGMLHYTSGGQFKIPIVIRGPGGVGRQLGAEHSQRLESYFQSIPGIQMVACSTPYNAKGLMKAAIRSENPVILFEHVLLYNLKERIPDEEYVLSLEEAEMVRPGEHVTILTYSRMRYHVMQAAKTLVNKGYDPEVIDIRSLKPFDLHTIGNSVKKTHRVLIVEECMRTGGIGASLTAAITENFHDHLDAPIVCLSSQDVPTPYAGTLEEWTVVQPAQIVTAVEQLCQ

SEQ ID NO: 71 - DNA, 1850 bp, Glycine max
  CDS (466)..(1683)
ccttcgtgcaaaaataccctgcgacggccaccaccaccatagccactttttttgttcgtccctgtatgttcaagatttctcacatctcggcctcattatttgtttagatccggattagagaatccgtaagtgtttgtgtttattccggactgtgcgttccgtaacatggaggtgcatgtcgaaattggtgaggtgcaggaagcaacgaccccactataaacggggttaagtccaatcagagaaggcaaaggcatcatcggtgatggaaactatgctcacaagtgacagagtagaagcaaaagattttaattttagtaataactaacataataaactaggtgaacgtaactgcacagacacaactactacataaatcttaccttaatttctccgcccacttccctcctataaataaatcttccattctctctcttcatttcatctccatctttcttgggtgatccaatggcgacccttttccagggattgggagttgtgaacccatcattgtcttcttccaactccaacaacttcctgcttccttctcgtacatccctctctgagagaaaagatggcatatttgtagtcagatctgatgcaagggtaagcagcaaggttctgaaggccggagctcgcaagcatgaattgttggttactaatgcagtcgcaacaaaggaaggcagttctgcggcttctacatcaaaatctgggcatgaacttctcctttttgaggccctacgtgaaggtttggaagaagaaatggagagggatccttgtgtatgtgtcatgggcgaagatgtaggtcactatggaggatcctacaaggtgactaaaggccttgccacaaagtttggggaccttagagttttggacacacctattgctgagaactccttcacgggcatgggcattggggctgccatgactggtctgaggccagttgttgagggcatgaacatgggatttctacttctggcatttaaccagatttctaacaattgtggcatgctccattacacttctggaggccagtttaagataccaattgtcattcgtggacctggtggagttgggcggcaacttggagcagagcactcgcagcgattggagtcatattttcagtcaatccctggaatccagatggtggcttgctcaaccccttacaatgccaagggcttgatgaaagctgcaatccggagtgagaaccctgtgattcttttcgagcatgttttgctttataacctcaaggagagaattccagatgaagagtatgtattgtcacttgaagaagctgagatggttaggcctggggagcatgttacaatattaacgtactccaggatgaggtatcatgtcatgcaagctgctaagacactggtgaacaaggggtatgaccctgaagtaattgatatcaggtctttgaaaccattcgatcttcacacaattgggaactcggtgaagaagacacatcgtgtgctaattgtggaagagtgtatgaggacgggtggaattggggctagtttgaccgctgctattactgaaaatttccatgactatttggatgcccctatagtatgtttatcctctcaggatgtgccaactccttatgctggcacattggaggaatggacagtggttcaacctgctcaaattgtgactgcagttgagcaactctgcaagtgattgctacaaaacactagcaattaggatatggtttttggtaaagctattgtgcttgtcaaattaagcttgaattttcatcatgactttcttttccttttatttctgaagtctatagcccgtaactttaaattgttgtttaatttctgataatctttgcaatttttttt

SEQ ID NO: 72 - protein, 405 aa, Glycine max
MATLFQGLGVVNPSLSSSNSNNFLLPSRTSLSERKDGIFVVRSDARVSSKVLKAGARKHELLVTNAVATKEGSSAASTSKSGHELLLFEALREGLEEEMERDPCVCVMGEDVGHYGGSYKVTKGLATKFGDLRVLDTPIAENSFTGMGIGAAMTGLRPVVEGMNMGFLLLAFNQISNNCGMLHYTSGGQFKIPIVIRGPGGVGRQLGAEHSQRLESYFQSIPGIQMVACSTPYNAKGLMKAAIRSENPVILFEHVLLYNLKERIPDEEYVLSLEEAEMVRPGEHVTILTYSRMRYHVMQAAKTLVNKGYDPEVIDIRSLKPFDLHTIGNSVKKTHRVLIVEECMRTGGIGASLTAAITENFHDYLDAPIVCLSSQDVPTPYAGTLEEWTVVQPAQIVTAVEQLCK

SEQ ID NO: 73 - DNA, 1491 bp, Triticum aestivum
  CDS (59)..(1240)
actaccaccgccgccgccgccctccccagcccccagatctccacccctcccatctgcaatggcggccgcttcgtcgctccacgtcgccgccccggccgccaccccgcgggtgggatctgccggccccaaatccgcgtcagcggcgaggagcgtgcgcgtggccagatcgggcgcggcggtgcgccctggaggcaggctggtggcttgcgccgccgttgcaaccaaggctgatgcgccggcgagcgaggcggcgtccaagtctgaaggtcatgaggtattgctgtttgaggctcttcgtgagggtttgatggaagagatgcaagcggatccaacggtgtgtgtctttggtgaagatgtcggtcactatgggggttcttacaaggtgaccaagggtttggctgatatgtttggagaccttcgtgttcttgacacaccaattgctgagaactcgttcaccggcatgggagttggagcaggaatgaaggggctgaggcctgttgttgaaggcatgaacatgggcttccttctccttgcttacaaccaaatctcaaacaactgcggtatgcttcattacacctctggcggccagttcaagataccacttgtgatccgaggtcctggtggtgttggtcgtcagcttggtgcagagcattcgcagcgcctggagtcatacttccagtcaatccctggtctccagatggttgcttgctccactccttacaatgccaagggtttaatgaaggctgccataaggagcgagaaccctgtcgtgctatttgagcacgtccttctgtacaacctgaaggagaaaattccggatgaggagtacactctatgcctggaggaggctgagatggtacggcctggtgagcatgtgaccatcctcacatactcgcgtatgaggtaccatgtgatgcaggctgcaaagacgctggtgaacaaagggtacgatcctgaggtgattgacattaggtcgttgaagccattcgatctgcacacaataggcaactccatcaagaagacccaccgcgtgctgattgtggaggagtgcatgcgcactggcgggattggcgccagtctgagatcggccatcatcgacaacttctgggactaccttgacgcccccatcatgtgcctgtcatctcaggacgtgccgacaccctacgccgcaactttggaggatgcgaccgtcgtgcagcctgcccagattgttgcggccgttgagcaaatatgccaatagggcgtcgtctgtttcagcatcgttaatttgtatctgccctggcttggaagaacctttaatttgtcatttttgccttgtagcgaggtgttcattgtggtataggcttgtatccattttttattcctgcttgagttaacacttgagctacataactgtactgtattatgctgaatgctactagggtctgaactcgggtttattggaagaaatctttgaatatcctgggcaaggtataactatgtgttttggct

SEQ ID NO: 74 - protein, 393 aa, Triticum aestivum
MAAASSLHVAAPAATPRVGSAGPKSASAARSVRVARSGAAVRPGGRLVACAAVATKADAPASEAASKSEGHEVLLFEALREGLMEEMQADPTVCVFGEDVGHYGGSYKVTKGLADMFGDLRVLDTPIAENSFTGMGVGAGMKGLRPVVEGMNMGFLLLAYNQISNNCGMLHYTSGGQFKIPLVIRGPGGVGRQLGAEHSQRLESYFQSIPGLQMVACSTPYNAKGLMKAAIRSENPVVLFEHVLLYNLKEKIPDEEYTLCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 75 - DNA, 1221 bp, Arabidopsis thaliana
  CDS (1)..(1221)
atgtcttcgataatccatggagctggagctgctacgacgacgttatcgacgtttaattccgtcgattccaagaaactcttcgttgctccttctcgcacaaatctttcagtgaggagccagagatatatagtggctggatctgatgcgagtaagaagagctttggttctggacttagagttcgtcactctcagaaattgattccaaatgctgttgcgacgaaggaggcggatacgtctgcgagcactggacatgaactattgcttttcgaggctcttcaggaaggtctggaagaagagatggacagagatccacatgtatgtgttatgggtgaagatgttggccattacggaggttcctacaaggtaaccaaaggccttgctgataaatttggtgacctcagggttctcgacactcctatttgtgaaaatgcattcaccggtatgggcattggagctgccatgactggtctaagacccgttattgaaggtatgaacatgggtttcctcctcctcgccttcaaccaaatctccaacaactgtggaatgcttcactacacatccggtggtcagtttacgatcccggttgtcatccgtggacctggtggagtgggacgccagcttggtgctgagcattcacagaggttagaatcttactttcagtccatccctgggatccagatggttgcttgctcaactccttacaacgccaaagggttgatgaaagccgcaataagaagcgagaaccctgtgattctgttcgaacacgtgctgctttacaatctcaaggagaaaatcccggatgaagattacgtctgtaaccttgaagaagctgagatggtcagacctggcgagcacattaccatcctcacttactcgcgaatgaggtaccatgtgatgcaggcagcaaaaactctggtgaacaaagggtatgaccccgaggttatcgacatcaggtcactgaaaccgttcgaccttcacacaattggaaactcggtgaagaaaacacatcgggttttgatcgtggaggagtgtatgagaaccggtgggattggggcaagtcttacagctgccatcaacgagaactttcatgactacttagatgctccggtgatgtgtttatcttctcaagacgttcctacaccttacgctggtacactggaggagtggaccgtggttcaaccggctcagatcgtgaccgctgtcgagcagctttgccagtaa

SEQ ID NO: 76 - protein, 406 aa, Arabidopsis thaliana
MSSIIHGAGAATTTLSTFNSVDSKKLFVAPSRTNLSVRSQRYIVAGSDASKKSFGSGLRVRHSQKLIPNAVATKEADTSASTGHELLLFEALQEGLEEEMDRDPHVCVMGEDVGHYGGSYKVTKGLADKFGDLRVLDTPICENAFTGMGIGAAMTGLRPVIEGMNMGFLLLAFNQISNNCGMLHYTSGGQFTIPVVIRGPGGVGRQLGAEHSQRLESYFQSIPGIQMVACSTPYNAKGLMKAAIRSENPVILFEHVLLYNLKEKIPDEDYVCNLEEAEMVRPGEHITILTYSRMRYHVMQAAKTLVNKGYDPEVIDIRSLKPFDLHTIGNSVKKTHRVLIVEECMRTGGIGASLTAAINENFHDYLDAPVMCLSSQDVPTPYAGTLEEWTVVQPAQIVTAVEQLCQ

SEQ ID NO: 77 - DNA, 1221 bp, Arabidopsis thaliana
  CDS (1)..(1221)
atgtcttcgataatccatggagctggagctgctacgacgacgttatcgacgtttaattccgtcgattccaagaaactcttcgttgctccttctcgcacaaatctttcagtgaggagccagagatatatagtggctggatctgatgcgagtaagaagagctttggttctggacttagagttcgtcactctcagaaattgattccaaatgctgttgcgacgaaggaggcggatacgtctgcgagcactggacatgaactattgcttttcgaggctcttcaggaaggtctggaagaagagatggacagagatccacatgtatgtgttatgggtgaagatgttggccattacggaggttcctacaaggtaaccaaaggccttgctgataaatttggtgacctcagggttctcgacactcctatttgtgaaaatgcattcaccggtatgggcattggagctgccatgactggtctaagacccgttattgaaggtatgaacatgggtttcctcctcctcgccttcaaccaaatctccaacaactgtggaatgcttcactacacatccggtggtcagtttacgatcccggttgtcatccgtggacctggtggagtgggacgccagcttggtgctgagcattcacagaggttagaatcttactttcagtccatccctgggatccagatggttgcttgctcaactccttacaacgccaaagggttgatgaaagccgcaataagaagcgagaaccctgtgattctgttcgaacacgtgctgctttacaatctcaaggagaaaatcccggatgaagattacatctgtaaccttgaagaagctgagatggtcagacctggcgagcacattaccatcctcacttactcgcgaatgaggtaccatgtgatgcaggcagcaaaaactctggtgaacaaagggtatgaccccgaggttatcgacatcaggtcactgaaaccgttcgaccttcacacaattggaaactcggtgaagaaaacacatcgggttttgatcgtggaggagtgtatgagaaccggtgggattggggcaagtcttacagctgccatcaacgagaactttcatgactacttagatgctccggtgatgtgtttatcttctcaagacgttcctacaccttacgctggtacactggaggagtggaccgtggttcaaccggctcagatcgtgaccgctgtcgagcagctttgccagtaa

SEQ ID NO: 78 - protein, 406 aa, Arabidopsis thaliana
MSSIIHGAGAATTTLSTFNSVDSKKLFVAPSRTNLSVRSQRYIVAGSDASKKSFGSGLRVRHSQKLIPNAVATKEADTSASTGHELLLFEALQEGLEEEMDRDPHVCVMGEDVGHYGGSYKVTKGLADKFGDLRVLDTPICENAFTGMGIGAAMTGLRPVIEGMNMGFLLLAFNQISNNCGMLHYTSGGQFTIPVVIRGPGGVGRQLGAEHSQRLESYFQSIPGIQMVACSTPYNAKGLMKAAIRSENPVILFEHVLLYNLKEKIPDEDYICNLEEAEMVRPGEHITILTYSRMRYHVMQAAKTLVNKGYDPEVIDIRSLKPFDLHTIGNSVKKTHRVLIVEECMRTGGIGASLTAAINENFHDYLDAPVMCLSSQDVPTPYAGTLEEWTVVQPAQIVTAVEQLCQ

SEQ ID NO: 79 - protein, 391 aa, Artificial sequence
  Description of the artificial sequence: consensus sequence
  Variant (2)..(6): Xaa in position 2 to 6 is any amino acid
  Variant (7)..(11): Xaa in position 7 to 11 is any or no amino acid
  Variant (13)..(15): Xaa in position 13 to 15 is any amino acid
  Variant (18)..(18): Xaa in position 18 is any amino acid
  Variant (20)..(24): Xaa in position 20 to 24 is any amino acid
  Variant (26)..(27): Xaa in position 26 to 27 is any amino acid
  Variant (31)..(36): Xaa in position 31 to 36 is any amino acid
  Variant (37)..(41): Xaa in position 37 to 41 is any or no amino acid
  Variant (43)..(43): Xaa in position 43 is any amino acid
  Variant (44)..(46): Xaa in position 44 to 46 is any or no amino acid
  Variant (48)..(49): Xaa in position 48 to 49 is any amino acid
  Variant (56)..(61): Xaa in position 56 to 61 is any amino acid
  Variant (64)..(64): Xaa in position 64 is any amino acid
  Variant (65)..(69): Xaa in position 65 to 69 is any or no amino acid
  Variant (79)..(79): Xaa in position 79 is any amino acid
  Variant (87)..(87): Xaa in position 87 is any amino acid
  Variant (91)..(91): Xaa in position 91 is any amino acid
  Variant (114)..(114): Xaa in position 114 is any amino acid
  Variant (127)..(127): Xaa in position 127 is any amino acid
  Variant (130)..(130): Xaa in position 130 is any amino acid
  Variant (132)..(132): Xaa in position 132 is any amino acid
  Variant (147)..(147): Xaa in position 147 is any amino acid
  Variant (178)..(178): Xaa in position 178 is any amino acid
  Variant (181)..(181): Xaa in position 181 is any amino acid
  Variant (250)..(250): Xaa in position 250 is any amino acid
  Variant (255)..(255): Xaa in position 255 is any amino acid
  Variant (257)..(259): Xaa in position 257 to 259 is any amino acid
  Variant (272)..(272): Xaa in position 272 is any amino acid
  Variant (345)..(345): Xaa in position 345 is any amino acid
  Variant (351)..(351): Xaa in position 351 is any amino acid
  Variant (356)..(357): Xaa in position 356 to 357 is any amino acid
SXXXXXXXXXXSXXXLSXRXXXXXVXXSDAXXXXXXXXXXXRXXXXLXXNAVATKXXXXXXSTXXXXXXHELLLFEALXEGLEEEMXRDPXVCVMGEDVGHYGGSYKVTKGLAXKFGDLRVLDTPIXENXFXGMGIGAAMTGLRPVXEGMNMGFLLLAFNQISNNCGMLHYTSGGQFXIPXVIRGPGGVGRQLGAEHSQRLESYFQSIPGIQMVACSTPYNAKGLMKAAIRSENPVILFEHVLLYNLKEXIPDEXYXXXLEEAEMVRPGEHXTILTYSRMRYHVMQAAKTLVNKGYDPEVIDIRSLKPFDLHTIGNSVKKTHRVLIVEECMRTGGIGASLTAAIXENFHDXLDAPXXCLSSQDVPTPYAGTLEEWTVVQPAQIVTAVEQLC

SEQ ID NO: 80 - protein, 62 aa, Artificial sequence
  Description of artificial sequence: amino acid sequence pattern comprised in a variant of SEQ ID NO: 64
  Variant (15)..(15): Xaa in position 15 is any amino acid
  Variant (18)..(19): Xaa in position 18 to 19 is any or no amino acid
  Variant (21)..(22): Xaa in position 21 to 22 is any or no amino acid
NNCGMLHYTSGGQFXIPXXIXXRGPGGVGRQLGAEHSQRLESYFQSIPGIQMVACSTPYNAK

SEQ ID NO: 81 - protein, 59 aa, Artificial sequence
  Description of artificial sequence: amino acid sequence pattern comprised in a variant of SEQ ID NO: 64
  Variant (13)..(13): Xaa in position 13 is Asn or Thr
  Variant (19)..(19): Xaa in position 19 is His or Tyr
  Variant (24)..(24): Xaa in position 24 is Ile or Val
  Variant (25)..(25): Xaa in position 25 is Met or Val
TGGIGASLTAAIXENFHDXLDAPXXCLSSQDVPTPYAGTLEEWTVVQPAQIVTAVEQLC

SEQ ID NO: 82 - protein, 60 aa, Artificial sequence
  Description of artificial sequence: amino acid sequence pattern comprised in a variant of SEQ ID NO: 64
  Variant (2)..(2): Xaa in position 2 is any amino acid
  Variant (6)..(6): Xaa in position 6 is any amino acid
  Variant (29)..(29): Xaa in position 29 is Asp, Pro or Thr
  Variant (42)..(42): Xaa in position 42 is Ala or Cys
  Variant (45)..(45): Xaa in position 45 is Ala or Ser
  Variant (47)..(47): Xaa in position 47 is any amino acid
MXRDPXVCVMGEDVGHYGGSYKVTKGLAXKFGDLRVLDTPIXENXFXGMGIGAAMTGLRP

SEQ ID NO: 83 - protein, 39 aa, Artificial sequence
  Description of artificial sequence: amino acid sequence pattern comprised in a variant of SEQ ID NO: 64
  Variant (18)..(18): Xaa in position 18 is any amino acid
  Variant (23)..(23): Xaa in position 23 is Asp or Glu
  Variant (25)..(25): Xaa in position 25 is Ile or Val
  Variant (26)..(26): Xaa in position 26 is any amino acid
  Variant (27)..(27): Xaa in position 27 is Asn or Ser
ENPVILFEHVLLYNLKEXIPDEXYXXXLEEAEMVRPGEH

SEQ ID NO: 84 - protein, 15 aa, Artificial sequence
  Description of artificial sequence: amino acid sequence pattern comprised in a variant of SEQ ID NO: 64
EGMNMGFLLLAFNQI

SEQ ID NO: 85 - protein, 26 aa, Artificial sequence
  Description of artificial sequence: amino acid sequence pattern comprised in a variant of SEQ ID NO: 64
  Variant (2)..(2): Xaa in position 2 is Ala, Asp or Ser
  Variant (3)..(3): Xaa in position 3 is Ser or Thr
  Variant (5)..(5): Xaa in position 5 is any amino acid
  Variant (7)..(9): Xaa in position 7 to 9 is any or no amino acid
  Variant (20)..(20): Xaa in position 20 is Gln or Arg
AXXSXSXXXGHELLLFEALXEGLEEE

SEQ ID NO: 86 - protein, 19 aa, Artificial sequence
  Description of artificial sequence: amino acid sequence pattern comprised in a variant of SEQ ID NO: 64
  Variant (2)..(2): Xaa in position 2 is any amino acid
  Variant (3)..(4): Xaa in position 3 to 4 is any or no amino acid
  Variant (7)..(7): Xaa in position 7 is any amino acid
  Variant (9)..(11): Xaa in position 9 to 11 is any amino acid
  Variant (12)..(12): Xaa in position 12 is any or no amino acid
  Variant (14)..(14): Xaa in position 14 is Phe or Val
  Variant (15)..(15): Xaa in position 15 is Ala or Val
  Variant (16)..(16): Xaa in position 16 is Gly or Val
  Variant (17)..(17): Xaa in position 17 is Arg or Ser
  Variant (18)..(18): Xaa in position 18 is Asp or Ser
  Variant (19)..(19): Xaa in position 19 is Ala, Asp or Ser
SXXXLSXRXXXXIXXXXXX

SEQ ID NO: 87 - DNA, 930 bp, Arabidopsis thaliana
  CDS (1)..(930)
atgtcgtcgtctgcgaagaaacaaaccctgttcatatcgacattaatcatctcatggtactcttcaaacatcggtgttcttctcctcaacaagttccttctctcgaattacggattcaaattcccgatttttctcacaatgtgtcacatgtccgcttgcgctatccttagctacatctccattgttttcctcaagcttgttcctctccaacatctcaaatctcgttctcaattccttaaggttgctactctcagcatcgtcttttgtgcttccgtcgtcggtggtaacatctcccttcgttaccttcctgtctctttcaatcaagccgtcggtgctacgacgccgtttttcacggctctgtttgcttatcttatgacctttaagagagaagcttgggttacttatggtgctctcgtccctgtcgtcgccggtgtcgtcatcgccagtgggggtgagccaggatttcactggtttgggttcataatgtgcattagtgctactgcggcaagagcctttaaatctgttcttcaaggcatcttactttcttcagagggggaaaaattgaactcaatgaatttgatgttgtatatgtctcccatagctgtcattgctcttcttcccgttacgctatttatggaaccagacgtgatcagtgtgaccttgacgcttgcaaaacaacatcagtacatgtggatacttcttctggttaactctgtcatggcttattcagccaatctgttgaattttctggttaccaaacacacaagcgccctcaccctccaggttcttggaaatgctaaaggagcagttgcagtggtgatttctatcttgatctttcaaaacccggttacggttatgggaattggcgggtactccataaccgtccttggggtggttgcttatggagagacaaaacgcagatttagatga

SEQ ID NO: 88 - protein, 309 aa, Arabidopsis thaliana
MSSSAKKQTLFISTLIISWYSSNIGVLLLNKFLLSNYGFKFPIFLTMCHMSACAILSYISIVFLKLVPLQHLKSRSQFLKVATLSIVFCASVVGGNISLRYLPVSFNQAVGATTPFFTALFAYLMTFKREAWVTYGALVPVVAGVVIASGGEPGFHWFGFIMCISATAARAFKSVLQGILLSSEGEKLNSMNLMLYMSPIAVIALLPVTLFMEPDVISVTLTLAKQHQYMWILLLVNSVMAYSANLLNFLVTKHTSALTLQVLGNAKGAVAVVISILIFQNPVTVMGIGGYSITVLGVVAYGETKRRFR

SEQ ID NO: 89 - DNA, 1386 bp, Brassica napus
  CDS (136)..(1062)
agacgacctttcctccttcttcaccaatcgcaactttctccaaatctcgattccaccattctccccgattcgatcaatcccctcataagaatcctcaaaccgaatcagatcgaagtgtagacttccccaaaaccgatgaagatggcggccaacggccgattcttcacgatcgggatcgtggcgtcgtggtactcgtccaacatcggagtgctactactaaacaagtacctgctgagcaactacgggttcaagtacccgatcttcctcacgatgtgccacatgacggcgtgctcgctcctcagctacgtggccatcgcgtggatgaagatggtccctatgcagacgatcaggtcccgcgtccagttcctcaagatcgcggcgctgagcctcgtcttctgcgtctccgtggtgttcgggaacatttcgctgaggtttcttccggtttcgtttaaccaggccatcggcgccacgacgccgtttttcacggccgtgtttgcgtatttgattacgttgaagaaggaggcgtggttgacttatgttacgctcgtgcccgttgttactggtgttgttattgctagtgggagtgaaccaagcttccacctgtttggattcattatgtgcgttgcagccacggctgcgagagcacttaaatcagttcttcaagggattttgctatcttcagaaggggagaagctaaactccatgaatctactcctctacatggctcccatagctgttgtgttccttcttcctgctacccttatcatggagaagaacgtcgttggcattacaattgcactcgccagagacgatttcagaatcgtttggtatctgctatttaattcggcgcttgcttatttcgtgaacttgactaacttcttagtcacaaaacacaccagcgctctgactctccaggtgctaggaaacgccaaaggagcagtagcagtggtggtatcgattttaatattcaagaatcctgtctcagtgactggaatgttaggctactcgctaacggtcattggagttatcctctacagtgaagccaagaaacgaagcaaatgaagttaaagaaacctcttcaatttttatttgttaggtccttgcaggtaaaacacacaaggcaaagttccttttgctggaccagaagcaaaaggatgtgtaaaggcaacaccaaaggatcagagtacccataagcaataagtggttttgtttccttctttaatttttgtttacgaatcttctacagcttttgtcataggttgttctaagagtaacttcgatgtagcttccttttttttggtcgattctttacatcttttgtgatacaacatttataacactgattaattaatggaaaagacaagttttttttaaaaaaaaaaaaaa

SEQ ID NO: 90 - protein, 308 aa, Brassica napus
MKMAANGRFFTIGIVASWYSSNIGVLLLNKYLLSNYGFKYPIFLTMCHMTACSLLSYVAIAWMKMVPMQTIRSRVQFLKIAALSLVFCVSVVFGNISLRFLPVSFNQAIGATTPFFTAVFAYLITLKKEAWLTYVTLVPVVTGVVIASGSEPSFHLFGFIMCVAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFKNPVSVTGMLGYSLTVIGVILYSEAKKRSK

SEQ ID NO: 91 - DNA, 1310 bp, Brassica napus
  CDS (94)..(1026)
agaagatttaaccaatacaaaaaatctctctgcttcttctccaatcgacctaatcaacaatcgattcgatcagattcggtcgatttcaatcagatgaagatggcggcggcggggaacggccggttcttcacaatcgggctcgtggcgtcgtggtactcgtcgaacatcggggtgctgctcctgaacaagtacctgctgagcaactacgggttcaagtacccgatcttcctcacgatgtgccacatgacggcgtgctcgctcctcagctacgtggccatcgcgtggatgaagatggtccctatgcagacggtccgatcccgcgttcagttcctcaagatcgcggcgctgagcctcgtgttctgcgtgtcggtggtgttcgggaacatctccctccggttccttccggtttcgtttaaccaggcgattggtgccacgacgccgtttttcacggcggtgtttgcgtatttgataacgatgaagagggaggcttggttgacttatgtcacgctcgtccctgtcgttaccggtgttgtcattgccagtgggggtgagccaagtttccacctgtttgggttcattatgtgcattgcagctacagctgcgagagcgcttaaatcagttcttcaagggattttgctatcttcagaaggggagaagctgaactccatgaatctcctgctttacatggctcccatagctgttgtgttccttcttcctgctacccttatcatggagaagaacgttgttggcatcacaatcgcacttgccagagacgattttagaatcgtttggtatctgcttttcaattctgctctcgcttatttcgtgaacttgaccaatttcttagtcaccaaacacaccagcgctttgactctgcaggtgctaggaaacgccaaaggtgcagtagcggtggtggtttcgatcctaatattcaagaaccctgtctcagtgactggaatgttgggttactcgctcactgtctgcggagttatcctctacagtgaagccaagaaacgaagcaaatgagaagtttctttttactgtgaacaagaaaccttaacacagcatcttgggaccaagcatcaaaggatcagagttccaacaagcaatcatttagaggacttgatgacaaatacgtgatatttttttccctttctttgctctttttcttttgtgttttctgcagcttttgtcgtaggttgttgttccgagagtaacttggatttagctttccttatttttttgtcgattcttttacaatctagttttgtgatatcaacaaacaaaaaaaaaagcaaaaaaaaaaaaaa

SEQ ID NO: 92 - protein, 310 aa, Brassica napus
MKMAAAGNGRFFTIGLVASWYSSNIGVLLLNKYLLSNYGFKYPIFLTMCHMTACSLLSYVAIAWMKMVPMQTVRSRVQFLKIAALSLVFCVSVVFGNISLRFLPVSFNQAIGATTPFFTAVFAYLITMKREAWLTYVTLVPVVTGVVIASGGEPSFHLFGFIMCIAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFKNPVSVTGMLGYSLTVCGVILYSEAKKRSK

SEQ ID NO: 93 - DNA, 1245 bp, Glycine max
  CDS (26)..(1009)
gtaatgatgagaggttgtgataaaaatggaaatccagggaggaggaggaggtagtggtggaggtggcaagagtgggaagacaatgtcccccaacagcaaggagaatctgtttatagtttttctggtgacactttggtactcttcaaacattggtgtgatccttctgaacaagtacctgctttcaaactatggattcaagttcccaatcttcctcacaatgtgccacatgtcagcttgtgctgttctcagctatatctccattgtgttcttcaaggtggtgcctcagcagatgatcaaatcaaggtcccagttcatcaagattgcaactttgagccttgtcttctgtgcctctgtggttggtggcaacatctccctcaagtacctggctgtgtccttcaaccaagcggtgggggcaaccacacccttcttcactgctgtctttgcctatttggccaccctcaaaagagaggcttgggttacctatggtgcccttattcctgttgttgctggagttgtcattgcaagtgggggcgagccagggtttcacttatttggattcattatgtgcctaagtgcaactgccgcaagagccttcaagtctgtccttcagagcattttactttcttctgaaggggaaaagttgaactcaatgaatttgctcctgtatatgtctccaatcgcggttctagttttgttgcctgcagcacttataatggagccaaatgtcgtagatgtcacattgacgcttgcaaaggaccataaatcaatgtggctacttctttttctaaactcagtcatagcgtatgcagcaaacttaacaaacttcttggtgactaaacataccagtgctctcacactccaggtattaggcaatgcaaaaggtgccgtagctgttgtaatctcaatactcctattcagaaaccctgtcactgttcttggcatgggtggctatacaattaccgtgatgggagtagctgcatatggagaaacaaaaaggaggtttagatgaacaatctctaacattcaccgattgtctgattcgtgtattttattgtagtttatttatatgaacaagattctttgtaacgtgactaggagtagaagggagccattttataatgttattctgttgtatctaccacataaatatttatttatcactggtacattttgtcctaagtaagtgtaccaaaaaaaaattgtaatgagttgaagcacgagaattatgcttaaaaaaaaaaaaaa

SEQ ID NO: 94 - protein, 327 aa, Glycine max
MEIQGGGGGSGGGGKSGKTMSPNSKENLFIVFLVTLWYSSNIGVILLNKYLLSNYGFKFPIFLTMCHMSACAVLSYISIVFFKVVPQQMIKSRSQFIKIATLSLVFCASVVGGNISLKYLAVSFNQAVGATTPFFTAVFAYLATLKREAWVTYGALIPVVAGVVIASGGEPGFHLFGFIMCLSATAARAFKSVLQSILLSSEGEKLNSMNLLLYMSPIAVLVLLPAALIMEPNVVDVTLTLAKDHKSMWLLLFLNSVIAYAANLTNFLVTKHTSALTLQVLGNAKGAVAVVISILLFRNPVTVLGMGGYTITVMGVAAYGETKRRFR

SEQ ID NO: 95 - DNA, 1368 bp, Hordeum vulgare
  CDS (54)..(1022)
ccggcgcctccctcctcctcagatccacgcgcgcccgcgcgcgaccagccgcgatgacggccaagggcggcgcgtcgccggcgccgggcggcgcgggagctgcggccaacgggcgcttcttcacggtcgggctcgtcaccgcctggtactcctccaacatcggcgtgctcctgctcaacaagtacctcctcagcaactacggcttcaagtaccccatcttcctcaccatgtgccacatgtccgcctgcgcgctcttctcctacgccgccatcgcctggctccggatcgtgcccatgcagctcgtgcgctcccgcgtacagctcgccaagatctccgcgctcagcctcgtcttctgcggctccgtcgtctccggcaacgtctcgctgcgctacctgcccgtgtccttcaaccaggccgtcggcgccaccacccctttcttcaccgccgtgttcgcctacatcatgaccgtcaagcgggagtcgtggatcacgtacctcactctcgtccccgtcgtcaccggcgtcgtcatcgccagcggcggcgagcctagttttcatctgtttggattcatcatgtgcattggagccactgccgcaagggcgttgaagactgtgttgcaaggaattcttctgtcgtctgagggggagaagcttaattctatgaacctgctcttgtacatggctccgattgctgtcattctcttgcttcctgctaccctgtttatggaggataatgttgttggcgttacaatagagctggccaaaaaggatttcaccattgtttggttgctgttgttcaactcttgcttgtcatattttgtcaatttgaccaatttcttggtgaccaaacatactagcgcattgaccctacaggtccttgggaacgcaaaaggtgccgtggcagtcgtcgtctcaattctgatattcaagaaccctgtgtctgtaaccggaatgcttggttacaccctcacagttataggcgtcattctttacagtgaatccaaaaagcgtagcaaaccctaagttcctccccagaaaatcgtacatatggccgtcctttctcagtccggtcggtggtgcccagagctaatatatgacggggaactacatccggggtgattgcaacagattctgtgatgtatgtagccggataacaagggcagagagaagtccaataatacctgtagttttcccttggatcgcagaggcactttgttttgctaatggaaatgatcaatagaatacaattttttgtgtttagagaattgtgggccgtggctcacactgccagcattggttgatacgcttagttcttggaaattgttttccgttattcatcagttattgtaagtccaaaaaaaaaaaaaaa

SEQ ID NO: 96 - protein, 322 aa, Hordeum vulgare
MTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVLQGILLSSEGEKLNSMNLLLYMAPIAVILLLPATLFMEDNVVGVTIELAKKDFTIVWLLLFNSCLSYFVNLTNFLVTKHTSALTLQVLGNAKGAVAVVVSILIFKNPVSVTGMLGYTLTVIGVILYSESKKRSKP

SEQ ID NO: 97 - DNA, 1115 bp, Helianthus annuus
  CDS (4)..(933)
cagatgaaggcaggcacgggcacagggcagtggttcacgatcgggcttgtgtcgtcatggtacgcatccaacatcggggtactccttctgaacaagtacctgctaagcaactacggattcaagtacccgatctttctgaccatgtgccacatgactgcttgttccttgctgagttacattgccatcgtttggatgaagacggtgcccttgcagactattaggtctagggctcagtttatgaagatctcggtgcttagcttagtgttttgtgcgtcggtggtgagtggcaacgtctcgcttaggtatctgcccgtctccttcacgcaggcggttggagccaccactcctttttttactgctgtctttgcttatattatgaccgtcaagagggaggcttggttgacctatttgactctggtgcctgttgtcaccggtgttgtcattgccagcgggggtgaaccaagtttccatttatttggttttatcatgtgtatcggtgctacagctgcaagagcattaaagtcagtgcttcaagggatattattgtcctcagacggggaaaaactgaattccatgaacctattgttgtacatggcgccagtagcagttgtgatattgcttccagcaacattgttgatggaagacaatgtggttggcatcaccatagctcttgctcgaaaagatgtgaatgtggtttggtatctgctcttcaattctgcaatggcgtattgtgtaaacttgaccaatttcttggttactaagcacacaagcgctttgacactccaggtgcttggaaatgctaaaggggcggttgctgttgtggtgtcgatattgatattcaagaatccagtgtcggtaacagggatgctaggatatttgctgactgtgttgggagtgatcctctatagcgaagccaagaagaggaccaagtaaacctaacatccttgagaccaaattttttagcttaattctttttgggagaaaacaaaacacactttaaagtccatttttttaatttgtatcctgtgacgtgaatatgcgtctactacgattgtataaatactgtagaattaaaacatctatacctgaccgttgcctccaaaaaaaaaaaaaaa

SEQ ID NO: 98 - protein, 309 aa, Helianthus annuus
MKAGTGTGQWFTIGLVSSWYASNIGVLLLNKYLLSNYGFKYPIFLTMCHMTACSLLSYIAIVWMKTVPLQTIRSRAQFMKISVLSLVFCASVVSGNVSLRYLPVSFTQAVGATTPFFTAVFAYIMTVKREAWLTYLTLVPVVTGVVIASGGEPSFHLFGFIMCIGATAARALKSVLQGILLSSDGEKLNSMNLLLYMAPVAVVILLPATLLMEDNVVGITIALARKDVNVVWYLLFNSAMAYCVNLTNFLVTKHTSALTLQVLGNAKGAVAVVVSILIFKNPVSVTGMLGYLLTVLGVILYSEAKKRTK

SEQ ID NO: 99 - DNA, 927 bp, Brassica napus
  CDS (1)..(927)
atgaagatggcggccaacggccgattcttcacgatcgggatcgtggcgtcgtggtactcgtccaacatcggagtgctactactaaacaagtacctgctgagcaactacgggttcaagtacccgatcttcctcacgatgtgccacatgacggcgtgctcgctcctcagctacgtggccatcgcgtggatgaagatggtccctatgtcgacgatttcgtcccgcgtccagttcctcaagatcgcggcgctgagcctcgtcttctgcgtctccgtggtgttcgggaacatttcgctgaggtttcttccggtttcgtttaaccaggccatcggcgccacgacgccgtttttcacggccgtgtttgcgtatttgattacgttgaagaaggaggcgtggttgacttatgttacgctcgtgcccgttgttactggtgttgttattgctagtgggagtgaaccaagcttccacctgtttggattcattatgtgcgttgcagccacggctgcgagagcacttaaatcagttcttcaagggattttgctatcttcagaaggggagaagctaaactccatgaatctactcctctacatggctcccatagctgttgtgttccttcttcctgctacccttatcatggagaagaacgtcgttggcattacaattgcactcgccagagacgatttcagaatcgtttggtatctgctatttaattcggcgcttgcttatttcgtgaacttgactaacttcttagtcacaaaacacaccagcgctctgactctccaggtgctaggaaacgccaaaggagcagtagcagtggtggtatcgattttaatattcaagaatcctgtctcagtgactggaatgttaggctactcgctaacggtcattggagttatcctctacagtgaagccaagaaacgaagcaaatga

SEQ ID NO: 100 - protein, 308 aa, Brassica napus
MKMAANGRFFTIGIVASWYSSNIGVLLLNKYLLSNYGFKYPIFLTMCHMTACSLLSYVAIAWMKMVPMSTISSRVQFLKIAALSLVFCVSVVFGNISLRFLPVSFNQAIGATTPFFTAVFAYLITLKKEAWLTYVTLVPVVTGVVIASGSEPSFHLFGFIMCVAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFKNPVSVTGMLGYSLTVIGVILYSEAKKRSK

SEQ ID NO: 101 - DNA, 1380 bp, Glycine max
  CDS (275)..(1201)
cggtcatcaatgttcctcaacagtaaagagaaatggtttacatcttttctggtgccactataattttctacaccatttgttatagtcctcatgaacaaatccctcatgttctatctgtctgtcccattcccaacattcctccaaaaagttcacatgacagcacatggtgttctcagctttatatccatagtcttcttcaaggttgcggcccaggcaacagtcaaaagaaagtgggggaggaggcggtggtggaggtggcaagagtggaaagacaatgtccaccaacagcaaggagaatttgttcatagtttttcttgttacactttggtactcttcaaacattggtgtgatccttctgaacaagtatctgctctcaaactatggattcaagttcccaatcttcctcacaatgtgccacatgtcggcctgtgctgtcctcagctatgtctccattgtgttcttcaaggtggtgcctcagcagatgatcaaatcaaggtcccagttcatcaagattgcaactttgagccttgttttctgtgcctctgtggttggtggcaacatttctctcaggtaccttgctgtgtcattcaaccaggctgttggggcaaccacaccctttttcactgctgtttttgcctatttggccaccctcaagagagaggcctgggttacctatggtgccctggttcctgttgttgctggagttgtcattgcaagtgggggcgagccagggtttcacttatttggattcattatgtgcctaagtgcaaccgctgcaagagccttcaagtctgtccttcagagcattttactctcttctgaaggggaaaagttgaactcaatgaacttgctcctgtatatgtctccaatcgcggtcctagttttgttgcctgcagcacttatcatggagcctaatgtcgtagatgtcatattgacgcttgcaaaggaccataaatctgtgtggctacttcttttcctaaactcagtcacagcatatgcagctaacttaacaaacttcttggtgactaaacataccagtgctctcacactccaggtgttaggcaatgcgaaaggtgctgtagctgttgtaatctcaatactcctattcagaaaccctgtcactgttcttggcatgggtggctatacaattaccgtgatgggagtggctgcatatggagaaacaaaaaggaggtttagatgaacaatctcaaacattcaccgattgtctgattcgtgtatttttattgtagtttatttatttatatgaacaagattctttgtaacgtgactaggagtagaagggagccattttataatgatattctgttgtatctaccacataaatatttatttatcactcgtacattttgtcctaagtaa

SEQ ID NO: 102 - protein, 308 aa, Glycine max
MSTNSKENLFIVFLVTLWYSSNIGVILLNKYLLSNYGFKFPIFLTMCHMSACAVLSYVSIVFFKVVPQQMIKSRSQFIKIATLSLVFCASVVGGNISLRYLAVSFNQAVGATTPFFTAVFAYLATLKREAWVTYGALVPVVAGVVIASGGEPGFHLFGFIMCLSATAARAFKSVLQSILLSSEGEKLNSMNLLLYMSPIAVLVLLPAALIMEPNVVDVILTLAKDHKSVWLLLFLNSVTAYAANLTNFLVTKHTSALTLQVLGNAKGAVAVVISILLFRNPVTVLGMGGYTITVMGVAAYGETKRRFR

SEQ ID NO: 103 - DNA, 1645 bp, Zea mays
  CDS (102)..(1073)
aaatcgcaaaccgattcaccgcgacccattcccccgtcattctcaccaccggcgcctcccccctcctcagatccacgcgcgcccgcgcgcgaccagccgcgatgacggccaagggcggcgcgtcgccggcgccgggcggcgcgggagctgcggccaacgggcgcttcttcacggtcgggctcgtcaccgcctggtactcctccaacatcggcgtgctcctgctcaacaagtacctcctcagcaactatggcttcaagtaccccatcttcctcaccatgtgccacatgtccgcctgcgcgctcttctcctacgccgccatcgcctggctccggatcgtgcccatgcagctcgtgcgctcccgcgtccagctcgccaagatctccgccctcagcctcgtcttctgcggctccgtcgtctccggcaacgtctcgctccgctacctgcccgtctccttcaaccaggccgtcggtgccaccacccctttcttcaccgccgtattcgcctacatcatgaccgtcaagcgggagtcgtggatcacgtacctcactctcgtccccgtcgtcaccggcgtcgtcatcgccagcggcggcgagcctagctttcatctgtttggattcatcatgtgcattggagccactgccgcaagggcgttgaagaccgtgtcggacgtggtcattctgtcttccgatggggagaagcttaattctatgaatctgttgttgtacatggctccaatcgctgttatcttcttgcttcctgcaactatctttatggaggataatgttgtcggcgttacaattgagcttgcaaagaaggatttcacgattgtttggttgcttttgttcaattcttgcttgtcgtattttgtcaatttgaccaatttcttggtgaccaagcatactagtgcactgactctacaggttctcggaaatgcaaagggtgccgtggcagttgtcgtctcgattatgatattcaggaatcccgtgtccataacaggaatgctcggttatactctcacagtttttggcgtcattctttacagcgaatccaaaaagcgcagcaacaagccatgaacaccctaggagacagtaaatatgggaaatcatttctttgtcctgtcagcgcctagagctaatatatgatgagaaatcacatcggtggcgaccacaacaaatcctatgccatactgcctcagcaattggacatcaaggatagaagtccaataactaccttggcatatgggaggcattttgttttatggcgttgatggatagaatataaatatttttttgtgtgtgttagagaactatggctcacactgccagcattggttgatacgtttagctcttgggaaattgcctcttgtattcatcttctgctgctgcagtttccattttgttttgttgtgaagaccacctataccacactttgatccaggttccgggacctaattaatatattgtgacactgaattgatgctcagttagcggacttttggtgacacaatgttgtcccatcatgactgccaatgtaaagtctacatgactacatagctacattgttggttcagatttgcatgcaactgcccagctgttttgactgtgaaaaaaaaaaaaaaaaaaactcgaactatctctcctcgtgc

SEQ ID NO: 104 - protein, 323 aa, Zea mays
MTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVSDVVILSSDGEKLNSMNLLLYMAPIAVIFLLPATIFMEDNVVGVTIELAKKDFTIVWLLLFNSCLSYFVNLTNFLVTKHTSALTLQVLGNAKGAVAVVVSIMIFRNPVSITGMLGYTLTVFGVILYSESKKRSNKP

SEQ ID NO: 105 - DNA, 1592 bp, Zea mays
  CDS (172)..(1146)
cattgggtacctcgaggccggccggggttacggacactcagctaaaaaaaaagtgccaagcgcccaagaccaaacccaccagcacagcaccaattcaaccgcgacccaacccaccgccccgcaccccattcccgcaccctcctcccccagatctccggccgcgacgacgccatgacggccaagggcggcgccacgccgtcccccggcggcgcgggccccgcggcggggaacggccgcctcttcaccgtcgggctggtcaccgcctggtactcctccaacatcggcgtgctcctgctcaacaagtacctcctcagcaactacggcttcaagtaccccatcttcctcaccatgtgccacatgtccgcctgcgccctgctctcctacgccgccatcgcctggctgcgcgtcgtgcccatgcagctcgtgcgctcccgcgtccagctcgccaagatcgccgcgctcagcctcgtcttctgcggctccgtcgtctccggcaacgtctcgctgcgctacctccccgtctccttcaaccaggcggtcggcgccaccacgcccttcttcaccgccgtcttcgcgtacatcatgaccgtcaagcgcgagtcgtggatcacctacctcaccctcgtgcccgtcgtcactggagtcatcatcgccagcggcggcgagcctagctttcatctgtttggattcatcatgtgcataggagcaactgcagcaagggcgttgaagacagtattgcaaggaattcttctgtcttccgatggggagaagcttaattctatgaatctgttattgtacatggctccaatcgctgttatcttcttgcttcctgcaactatctttatggaggataatgttgttggcatcacaattcagcttgcaaagaaggatttcacgattgtttggttgctactgttcaattcttgcttgtcatattttgtcaatttgaccaatttcttggtgaccaaacatactagcgcactgactctacaggttctcggaaatgcaaagggtgccgtggcagtcgtcatctcaatcatgatattcaggaatcctgtgtccataacaggaatgctcggttacactctcacagtttttggcgtcattctttacagtgaatccaaaaagcgcagcaacaagccgtgaccaccctagaagacagtaaatacggccatcatttctttgtcctgccagcgcctagagctaatatatgatgagaaactacaccggtggcgatcacaacaaatccaatgccgtaccgcctcagcaattggacatcaagggtagaagtccaataatacctgtagtattaaattggcatgtgggaggcattttttttaatggcattgatggatagaatatatatattttttgtgttagagaagtgtggctcagactgccagcattggttagtacgtttagctcttgggatattgcctcttctattcatcggctactgtaacttccattttcttttgttctgaagactacctgtaccagactttgatccaggttccagggcctaattaatatattgacactgaatttaagctcaaaaaaaaaaaaaaaaaaaaaaaaaaaaaaaacaaaaa

SEQ ID NO: 106 - protein, 324 aa, Zea mays
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWITYLTLVPVVTGVIIASGGEPSFHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTVFGVILYSESKKRSNKP

SEQ ID NO: 107 - DNA, 1452 bp, Zea mays
  CDS (70)..(1044): subsp. mays
tccccgcgcgcccgcgcgcgagctcgttcgtgcgcggccgccggcgttggcgacgacgaccgaggagccatggcggccaagggcggcgccacgccgtcccccggcggcacggggcccgcggcggggaacggccgcctcttcacggtggggctagtcacggcctggtactcctccaacatcggcgtgctcctgctcaacaagtacctcctcagcaactacggcttcaagtaccccatcttcctcaccatgtgccacatgtccgcctgcgccctgctctcctacgccgccatcgcctggctgcgcgtcgtgcccatgcagctcgtgcgctcccgcgtccagctcgccaagatcgccgcgctcagcctcgtcttctgcggctccgtcgtctccgggaacgtctcgctgcgctacctccccgtgtccttcaaccaggccgtcggcgccaccacgcccttctttaccgccgtcttcgcgtacatcatgaccgtcaagcgcgagtcgtggatcacctacctcaccctcgtgcccgtcgttactggagtcatcatcgccagcggcggcgagcctagctttcatctgtttggattcatcatgtgcataggagcaactgcagcaagggcgttgaagacagtactgcaaggaattcttctgtcttctgatggggagaagcttaattctatgaatctgttattgtacatggctccaattgctgttattttcttgcttcctgcaactatctttatggaggataatgttgttggcatcacaattcagcttgcaaagaaggatttcacgattgtttggttgctactgttcaattcttgcttgtcatattttgtcaatttgaccaatttcttggtgaccaaacatactagcgcactgactctacaggttctcggaaatgcaaagggtgccgtggcagtcgtcatctcaatcatgatattcaggaatcctgtgtccataacaggaatgctcggttacactctcacagtttttggcgtcattctttacagtgaatccaaaaagcgcagcaacaagccgtgaccaccctagaagacagtaaatacggccatcatttctttgtcctgccagcgcctagagctaatatatgatgagaaactacaccggtggcgatcacaacaaacccaatgccgtaccgcctcagcaattggacatcaagggtagaagtccaataatacctgtagtattaaattggcatgtacgaggcattttttttaatggcattgatggatagaatacatatattttttgtgttagagaagtgtggctcagactgccagcattggttagtacgtttagctcttgggatattgcctcttctattcatcggctactgtaacttctattttcttttgttctgaagactacctgtaccagactttgatccaggttccagggcctaattaatatattgacactgaatttaagctt

SEQ ID NO: 108 - protein, 324 aa, Zea mays
  subsp. mays
MAAKGGATPSPGGTGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWITYLTLVPVVTGVIIASGGEPSFHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTVFGVILYSESKKRSNKP

SEQ ID NO: 109 - DNA, 1452 bp, Zea mays; identical to SEQ ID NO: 107
  CDS (247)..(1044): subsp. mays

SEQ ID NO: 110 - protein, 265 aa, Zea mays
  subsp. mays
MCHMSACALLSYAAIAWLRVVPMQLVRSRVQLAKIAALSLVFCGSVVSGNVSLRYLPVSFNQAVGATTPFFTAVFAYIMTVKRESWITYLTLVPVVTGVIIASGGEPSFHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTVFGVILYSESKKRSNKP

SEQ ID NO: 111 - DNA, 1360 bp, Glycine max
  CDS (226)..(1164)
ataaaccctgcaccttccaacaatcacttctctcctccttccttctcacttctcacttctcaccaattacgttaccttgcactattattctatacaactgtaaacatccttaattgcaaaccctctctctctctccttaaataattctcataaaaaaataaaataaaaattaaaactaacaaagaaaccattttgcacaaacccaattgagagtttgagacccagatgatgatgatgaacaatactattattccatggtcaaccattggcgttgtgattgcatggtacacttccaacataggggttcttcttctgaacaagtacttgctaagcaactacggctttaggttccccgtgttcctcaccacgtgtcacatgctggtgtgctcgctcttcagctacgttattgtttccgttacggaagctgttccgctgcagcgcgtgcggtccaggagccagttttggaggatcgtggcgctcggcgtcgttttctgcttctccgtcgtttgcgggaacgtgtcgctcaggtacattccggtgtcgtttaatcaggccatcggcgccaccacgccgttcttcaccgccgttttcgcttatgctgtcagcgccaagagggaggcttgggttacgtacgccacgctcttgcccgttgttgcgggcgtcgtcatagctagtgggggtgaaccaagttttcatctgtttggatttataatctgtgtttcatcgactggtgccagagcatttaaatcagtgcttcaagatattttgttgtcctcagagggagaaaagttgaattctatgaacctgctgctttatatggctccaatagcagtgatggtcttacttcctacaatattgttgatggagggaaatgtgattcagatcactatggatcttgccagaaaggatataagaattttttggtatctgcttctcagttcttctcttgcatattttgtgaacctcactaattttttggtgaccaaacatacaagtgcacttacccttcaggttttaggaaatgcaaagggggcagttgctgtggtggtctcaattttgatattcaaaaaccccatttcaatgataggaatgcttggctatgcactcactatcattggagttatcttgtacagtgaaaccaagaagaggtatagcaaaaattagtaaaattaacaagattaccaatcaaagcagggtgtgatttaccacaagcgagagggccaacaagttatacttatgcatacaaaattatgagcttgcagcaaccacttttgttacacgtgaacaagaatatttcccccctaactatttcattcattgcaagcgttttgggagtagtcacactccccataaacccttt

SEQ ID NO: 112 - protein, 312 aa, Glycine max
MMMMNNTIIPWSTIGVVIAWYTSNIGVLLLNKYLLSNYGFRFPVFLTTCHMLVCSLFSYVIVSVTEAVPLQRVRSRSQFWRIVALGVVFCFSVVCGNVSLRYIPVSFNQAIGATTPFFTAVFAYAVSAKREAWVTYATLLPVVAGVVIASGGEPSFHLFGFIICVSSTGARAFKSVLQDILLSSEGEKLNSMNLLLYMAPIAVMVLLPTILLMEGNVIQITMDLARKDIRIFWYLLLSSSLAYFVNLTNFLVTKHTSALTLQVLGNAKGAVAVVVSILIFKNPISMIGMLGYALTIIGVILYSETKKRYSKN

SEQ ID NO: 113 - DNA, 1360 bp, Glycine max; identical to SEQ ID NO: 111
  CDS (229)..(1164)

SEQ ID NO: 114 - protein, 311 aa, Glycine max
MMMNNTIIPWSTIGVVIAWYTSNIGVLLLNKYLLSNYGFRFPVFLTTCHMLVCSLFSYVIVSVTEAVPLQRVRSRSQFWRIVALGVVFCFSVVCGNVSLRYIPVSFNQAIGATTPFFTAVFAYAVSAKREAWVTYATLLPVVAGVVIASGGEPSFHLFGFIICVSSTGARAFKSVLQDILLSSEGEKLNSMNLLLYMAPIAVMVLLPTILLMEGNVIQITMDLARKDIRIFWYLLLSSSLAYFVNLTNFLVTKHTSALTLQVLGNAKGAVAVVVSILIFKNPISMIGMLGYALTIIGVILYSETKKRYSKN

SEQ ID NO: 115 - DNA, 1360 bp, Glycine max; identical to SEQ ID NO: 111
  CDS (232)..(1164)

SEQ ID NO: 116 - protein, 310 aa, Glycine max
MMNNTIIPWSTIGVVIAWYTSNIGVLLLNKYLLSNYGFRFPVFLTTCHMLVCSLFSYVIVSVTEAVPLQRVRSRSQFWRIVALGVVFCFSVVCGNVSLRYIPVSFNQAIGATTPFFTAVFAYAVSAKREAWVTYATLLPVVAGVVIASGGEPSFHLFGFIICVSSTGARAFKSVLQDILLSSEGEKLNSMNLLLYMAPIAVMVLLPTILLMEGNVIQITMDLARKDIRIFWYLLLSSSLAYFVNLTNFLVTKHTSALTLQVLGNAKGAVAVVVSILIFKNPISMIGMLGYALTIIGVILYSETKKRYSKN

SEQ ID NO: 117 - DNA, 1519 bp, Zea mays
  CDS (97)..(1116)
atccgcgccccattagcaactgcgcgcacctcctgacctccactccagccgtctcctccctccgcgtccggctcccggttccgttccgcttccgcgatggggcagcaagagggccacagcaacccccaccccgacgaggcggcgctcccgacgaccaccgccgcaccgtcgccgtcgccgtcgccgtcgccgtcgccgtcctcgtccaggctctacacggcgtggctggtggcgtcgtggtacgcgtccaacatcggcgtgctgctgctcaacaagtacctgctctccgtgtacggcttccgcttcccgctgctgctgaccgcgtgccacatgtccgcctgcgccgtcctctccacgctcgcccagcacgcctcgccccgcccccgcagcagctcctccccgcgctcccaccgccagctcgctcgcgtcgcgctcctcggcgccgtcttctgcgcgtccgtcgtcgccgggaacgtctcgctccgccacctccccgtctccttcaaccaggccgtcggcgccaccacgcctttcttcaccgcgctcctcgcctacgccgtcgccgcccgccgcgaggcctgcgccacctacgccgcgctcgtccccgtcgtcgccggcgtcgccatcgccaccgggggcgagccgagcttccacctcttcggattcgtcatgtgcgtggccgccacggtggggcgcgcgctcaagaccgtgctgcagggcatcctgctatcgtccgaggaggagaagatggactccatggacctcctccgctacatggcgccggtggccgtgctgctgctggtaccggcgacgctggccatggagcgggacgcgttcggcgtggtggcgggcctcgcgcgggaggaccccagcttcctctggctcctgctctgcaactcctgcctcgcctacttcgtcaacctcaccaacttcctcgtcacaaagcacaccagcccgctcactctccaggtcctcgggaacgccaaaggcgccgtcgccgtcgtcgtctccatcctcatcttcaggaaccccgtcacggtcgtgggcatgctgggctacggggtcacggtcgctggcgtcgtcttgtacggcgaggccaagaagaggagcaagtgaagcgacggacaggctcctgtacctgtacatttgctgtccggccttggaatgcaacgccggcggtgatagctagggagaagacaagcaagcaaagcgacagctggggtggtttgttcgtcgcatcgtttcagaaggaggtgaaccatacaatacaagaactcgtgtcgtagcacagagagagagagtgtgtgtcgtttagcatttgaacgagcttgccgtccaaagcctacgattttaatccggcctggagaagaagaaaaaaaacgaagctagctaattatcaaaccaacacctagcatctgaacatatgtgcagcaatccaactgggtttccatattttaatgttgtcgatgaattggtccttcctaaacaacatttccgtttgaacaaaaaaaaaaaaaaa

SEQ ID NO: 118 - protein, 339 aa, Zea mays
MGQQEGHSNPHPDEAALPTTTAAPSPSPSPSPSPSSSRLYTAWLVASWYASNIGVLLLNKYLLSVYGFRFPLLLTACHMSACAVLSTLAQHASPRPRSSSSPRSHRQLARVALLGAVFCASVVAGNVSLRHLPVSFNQAVGATTPFFTALLAYAVAARREACATYAALVPVVAGVAIATGGEPSFHLFGFVMCVAATVGRALKTVLQGILLSSEEEKMDSMDLLRYMAPVAVLLLVPATLAMERDAFGVVAGLAREDPSFLWLLLCNSCLAYFVNLTNFLVTKHTSPLTLQVLGNAKGAVAVVVSILIFRNPVTVVGMLGYGVTVAGVVLYGEAKKRSK

SEQ ID NO: 119 - DNA, 921 bp, Mesembryanthemum crystallinum
  CDS (1)..(921)
atgaagaacacgagcagattcttcacgatcgggctcgtcacatcatggtattcatcaaacattggggttttgttgctcaacaagtacttgctcagcaattatgggttcaagtacccgatcttcctcactatgtgtcatatgacggcttgctctttgctcagctacatcgccatcgcttggatgaagatggtccctatgcaaactattcgatcgagggtgcaattctttaagatcactgctcttagcctcattttctgtgcttctgttgttagtggcaacatttcgctgaagtatcttccggtgtcgtttaatcaagcaattggtgctacgacgccgttcttcactgctgtttttgcttaccttatgaccttcaagagggaggcttggctcacttatgtcactctcgttccggttgttaccggcgtcatcattgctagtgggggtgaaccaagtttccaccttttcgggtttataatgtgtataggtgcaacagctgctagagctcttaagtcggtgcttcagggtatcctgctgtcctctgaaggggagaagctgaattctatgaacctcctactctacatggctcctatagctgttgtatttcttctccctgcaacacttttcatggaagaaaatgtggttggtatcacgctggcacttgcaagggaggatgtcaagattgtctggtatctaattttcaattctgcgttggcgtattttgtgaatctaaccaacttcctggtcacaaaacacaccagtgctttgactctccaggtgcttggaaatgcaaagggtgctgttgctgttgtagtctcaattatgatctttaagaaccctgtctcagttactgggatgcttggttattctcttacggtccttggggtcatcctatatagtgaagcgaagaaaagaagcaaatga

SEQ ID NO: 120 - protein, 306 aa, Mesembryanthemum crystallinum
MKNTSRFFTIGLVTSWYSSNIGVLLLNKYLLSNYGFKYPIFLTMCHMTACSLLSYIAIAWMKMVPMQTIRSRVQFFKITALSLIFCASVVSGNISLKYLPVSFNQAIGATTPFFTAVFAYLMTFKREAWLTYVTLVPVVTGVIIASGGEPSFHLFGFIMCIGATAARALKSVLQGILLSSEGEKLNSMNLLLYMAPIAVVFLLPATLFMEENVVGITLALAREDVKIVWYLIFNSALAYFVNLTNFLVTKHTSALTLQVLGNAKGAVAVVVSIMIFKNPVSVTGMLGYSLTVLGVILYSEAKKRSK

SEQ ID NO: 121 - DNA, 1086 bp, Arabidopsis thaliana
  CDS (1)..(1086)
atggttgaagctcaatcatggacaacgcggcggatgagcaatcctagattcgacgccgccgcaaccgccgcaccaaccatcgtagacatccccggaacaccaccacactcctccgcttcttcaccactcaaacccttcttcctctcttcccccaccgtatcaccaacaatcctcacggcggctataatcgccgcctggtttggctcaaatataggagtcctcctcttaaacaaataccttctcttctactacggtttccgttacccaatcttcctcaccatgacacacatgttatcatgcgccgcctatagctccgccgtaatcaatatcgccggaatcgtgccacgtcagcacatcttatctcgccgtcagtttctaaagatcctctctttgtcagcgatcttttgtctctccgtcgtctgtggcaacacttcgctacgttatatccctgtttcttttaatcaagctattggagctacgacgccgtttttcaccgccgtgttctcttttctcattacttgtaaaacagagtccactgaagtttatttagctcttcttccggttgtctccggcatcgttcttgcttctaactctgaaccttcttttcatctttttggtttccttatctgtgttgcttccaccgccggtagagctctcaaatccgtcgtccaggggattattctgacgtcggaatcggagaagctacattctatgaatcttttgctatacatggctccaatggcggcttgtatcttactaccatttacgctatacattgaaggaaacgttttaagagttctaatcgagaaagcgaggacggatccattgatcatcttcttgttagccgggaatgcgacagtggcatatttagtgaatttgacgaatttcttggtgacaaagcatacaagtgctctcacattgcaggttttggggaacggaaaagctgcggtggctgccggagtctcggttttgatatttaggaatccggtgacggtgatgggaatagccggatttggtgtgacgattatgggtgtggttctctatagcgaagctaggaagagatccaaattgctaaaccagaagtga

SEQ ID NO: 122 - protein, 361 aa, Arabidopsis thaliana
MVEAQSWTTRRMSNPRFDAAATAAPTIVDIPGTPPHSSASSPLKPFFLSSPTVSPTILTAAIIAAWFGSNIGVLLLNKYLLFYYGFRYPIFLTMTHMLSCAAYSSAVINIAGIVPRQHILSRRQFLKILSLSAIFCLSVVCGNTSLRYIPVSFNQAIGATTPFFTAVFSFLITCKTESTEVYLALLPVVSGIVLASNSEPSFHLFGFLICVASTAGRALKSVVQGIILTSESEKLHSMNLLLYMAPMAACILLPFTLYIEGNVLRVLIEKARTDPLIIFLLAGNATVAYLVNLTNFLVTKHTSALTLQVLGNGKAAVAAGVSVLIFRNPVTVMGIAGFGVTIMGVVLYSEARKRSKLLNQK

SEQ ID NO: 123 - DNA, 1068 bp, Arabidopsis thaliana
  CDS (1)..(1068)
atgtcgtcccatgctcgaggtaaggagctaattcctctcctgtctttctcccaccaaaaaaaacaaccaaatctctcgatctcatcgacgacgaagatgaacaagaagaacccagatcagaaatccgacatgtcgtcttcttcatcttctccgaagaaacaaaccctcttcatatcatccttaatcattctctggtacacctccaacatcggtgttcttctcctcaacaagttcctcctctccaattacggattcaaattccctattttcctcacaatgtgtcacatgtccgcttgcgctatcctcagctacgtctccatcgtcttcctcaagctcgtccctctccaatacctcaaatctcgttctcagtttctcaaggttgcgactctcagcattgtcttttgtgcctctgtcgtcggtggaaacatctcccttcgttatctccctgtctcctttaatcaagccgttggtgctacgacgccgtttttcactgcactcttcgcttatatcatgacctttaagagagaagcttgggtcacttatggcgctctcgtccccgttgttaccggtgtcgttatcgccagtgggggtgaaccaggttttcactggtttggattcattatgtgcattagtgctactgcagcaagagcttttaaatctgttcttcaaggcatcttactttcttccgagggagaaaggttgaattcgatgaatttgatgctgtacatgtctccaatagccgtcattgctcttctgcctgtcacaatttttatggagccggacgtgatgagtgtgacactaacactcggaagacaacataagtacatgtatatacttctgctggttaactctgtaatggcttattcagccaacttgttaaactttctggttaccaagcacacaagcgcacttaccctgcaggtccttggaaatgctaaaggagcggttgcagttgtgatatcgatcctgcttttccgaaacccggtaacggtgatgggaattggcgggtacagtataaccgttctcggggtggttgcttatggagagactaaacgcaggtttagatga

SEQ ID NO: 124 - protein, 355 aa, Arabidopsis thaliana
MSSHARGKELIPLLSFSHQKKQPNLSISSTTKMNKKNPDQKSDMSSSSSSPKKQTLFISSLIILWYTSNIGVLLLNKFLLSNYGFKFPIFLTMCHMSACAILSYVSIVFLKLVPLQYLKSRSQFLKVATLSIVFCASVVGGNISLRYLPVSFNQAVGATTPFFTALFAYIMTFKREAWVTYGALVPVVTGVVIASGGEPGFHWFGFIMCISATAARAFKSVLQGILLSSEGERLNSMNLMLYMSPIAVIALLPVTIFMEPDVMSVTLTLGRQHKYMYILLLVNSVMAYSANLLNFLVTKHTSALTLQVLGNAKGAVAVVISILLFRNPVTVMGIGGYSITVLGVVAYGETKRRFR

SEQ ID NO: 125 - DNA, 927 bp, Arabidopsis thaliana
  CDS (1)..(927)
atgaagatagcggccaatggccggtttttcacaatcggactcgtagcgtcatggtattcatcgaacatcggagttttattgctgaacaagtacttgttaagcaactatggattcaagtatccgatcttcctcaccatgtgtcacatgacggcttgttctcttctcagctacgttgctattgcttggatgaagatggttccgatgcaaacgatccgatctcgagttcagtttcttaagatcgctgcgttaagtctcgttttctgtgtgtcggtggtttttgggaatatctctcttcggtttcttcctgtatcgtttaatcaagcgattggtgctacgacgccgtttttcaccgccgtgtttgcttatctgattacttttaagagagaagcttggttgacttacttcactctcgtccctgttgttaccggtgttgtcattgccagtgggagtgagccaagtttccacctgtttggattcattatgtgcattgcagctacagctgcaagagcacttaaatcagttcttcaaggaattttgctttcttcagaaggggagaagctaaattccatgaacctcctcctttacatggctcccatagctgttgtgttcctccttcctgctacacttatcatggaaaaaaatgttgttggcattacaattgcacttgccagagacgattttagaatcgtttggtatctgctattcaattcggcgctagcttattttgtgaacttgaccaatttcttagtcacgaaacacaccagcgctctgactctccaggtgctaggaaacgccaaaggtgcagtagcagtggtggtatcaatcctgatattcaggaatcctgtctcagtgactggaatgttaggttactcgctcactgtctgtggagttatcctctacagcgaagccaagaaacgaagcaaataa

SEQ ID NO: 126 - protein, 308 aa, Arabidopsis thaliana
MKIAANGRFFTIGLVASWYSSNIGVLLLNKYLLSNYGFKYPIFLTMCHMTACSLLSYVAIAWMKMVPMQTIRSRVQFLKIAALSLVFCVSVVFGNISLRFLPVSFNQAIGATTPFFTAVFAYLITFKREAWLTYFTLVPVVTGVVIASGSEPSFHLFGFIMCIAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFRNPVSVTGMLGYSLTVCGVILYSEAKKRSK

SEQ ID NO: 127 - DNA, 930 bp, Arabidopsis thaliana
  CDS (1)..(930)
atgaagatggcgacgaatggccggtttttcacaatcgggctagtcgcgtcttggtactcatcgaacattggtgtattgttgctgaacaagtacttgcttagcaattacggattcaagtacccgatctttctcaccatgtgtcacatgacggcttgttcgttactcagctacgtcgccattgcttggttgaagatggttccgatgcagacgattcgatccagagttcagttctttaagatcgcagctctaagtctcgttttttgtgtgtcggtggtctttggtaacatctctctccgctttcttcctgtttcgtttaaccaagccattggtgctacgacgccgtttttcaccgccgtgtttgcttacctgatgacgcgtaagaaagaggcttggttgacttacttcactctcgtccctgtcgtcaccggagttgttattgctagtgggggtgagccaagctttcacctgtttggattccttatgtgcattgcagcaacagctgcgagagcacttaaatcagtgcttcaaggaattttgctttcttctgaaggggaaaagctgaactccatgaatctcctcctttacatggctccaatagctgtcgtgctccttctgcctgctactcttatcatggagaaaaatgttgtcggcattacaattgcacttgcaagagatgatttcagaatcgtttggtatcttctattcaattcagcgctcgcctatttagtcaacttgacaaatttcttagtcacaaaccacactagcgccctgactttacaggtgctaggaaacgccaaaggagcagtagcagtggtggtctctattctaatcttcaagaatccggtgtcagtgaccggaatgctgggttactccctcaccgtctgtggagttatcctgtacagcgaagccaagaaacgaaacaaaaattag

SEQ ID NO: 128 - protein, 309 aa, Arabidopsis thaliana
MKMATNGRFFTIGLVASWYSSNIGVLLLNKYLLSNYGFKYPIFLTMCHMTACSLLSYVAIAWLKMVPMQTIRSRVQFFKIAALSLVFCVSVVFGNISLRFLPVSFNQAIGATTPFFTAVFAYLMTRKKEAWLTYFTLVPVVTGVVIASGGEPSFHLFGFLMCIAATAARALKSVLQGILLSSEGEKLNSMNLLLYMAPIAVVLLLPATLIMEKNVVGITIALARDDFRIVWYLLFNSALAYLVNLTNFLVTNHTSALTLQVLGNAKGAVAVVVSILIFKNPVSVTGMLGYSLTVCGVILYSEAKKRNKN

SEQ ID NO: 129 - DNA, 969 bp, Oryza sativa
  CDS (1)..(969): Japonica cultivar group
atgacggccaagggcggcgccgcgccgtcgccgggcggcgcgggcggcctcccgaacggccgcttcttcaccgtggggctcgtcaccgcctggtactcctccaacatcggcgtcctcctcctcaacaagtacctcctcagcaactacggcttcaagtacccaatcttcctcaccatgtgccacatgtccgcctgcgccctcctctcctacgccgccatcgcctggctccgcgtcgtccccatgcagctcgtccgctcccgcgtccagctcgccaagatcgccgccctcagcctcgtcttctgcggctccgtcgtctccggcaacgtctcgctccgctacctccccgtctccttcaaccaggccgtcggcgccaccacccccttcttcaccgccgtcttcgcctacatcatgaccgtcaagagggagtcctgggtcacctacctcaccctcgtccccgtcgtcaccggcgtcatgatcgccagcggaggagagcctagctttcatctgtttggattcatcatgtgcattggggccactgctgcaagggcattgaagacggtgttgcaaggaatcctcctttcatccgagggggagaagcttaattctatgaatttgcttttatacatggctccaattgctgttattctcttgctccctgctaccatcttcatggaggacaacgttgttggcattacaatagaactggccaaaaaggacaccacgattgtttggttgctgctgttcaattcctgtttggcatattttgtcaatttgaccaatttcttggtgactaagcatactagtgcattgactctacaggtcctaggtaacgcgaaaggtgctgtggcagttgttgtctcaattctaatattcaggaatcccgtatctgtaaccggaatgctcggttacactcttacagttataggcgtaattctttacagtgaatccaaaaaacgcaacaagccctga

SEQ ID NO: 130 - protein, 322 aa, Oryza sativa
  Japonica cultivar group
MTAKGGAAPSPGGAGGLPNGRFFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVMIASGGEPSFHLFGFIMCIGATAARALKTVLQGILLSSEGEKLNSMNLLLYMAPIAVILLLPATIFMEDNVVGITIELAKKDTTIVWLLLFNSCLAYFVNLTNFLVTKHTSALTLQVLGNAKGAVAVVVSILIFRNPVSVTGMLGYTLTVIGVILYSESKKRNKP

SEQ ID NO: 131 - DNA, 927 bp, Glycine max
  CDS (1)..(927)
atgtcccccaacagcaaggagaatctgtttatagtttttctggtgacactttggtactcttcaaacattggtgtgatccttctgaacaagtacctgctttcaaactatggattcaagttcccaatcttcctcacaatgtgccacatgtcagcttgtgctgttctcagctatatctccattgtgttcttcaaggtggtgcctcagcagatgatcaaatcaaggtcccagttcatcaagattgcaactttgagccttgtcttctgtgcctctgtggttggtggcaacatctccctcaagtacctggctgtgtccttcaaccaagcggtgggggcaaccacacccttcttcactgctgtctttgcctatttggccaccctcaaaagagaggcttgggttacctatggtgcccttattcctgttgttgctggagttgtcattgcaagtgggggcgagccagggtttcacttatttggattcattatgtgcctaagtgcaactgccgcaagagccttcaagtctgtccttcagagcattttactttcttctgaaggggaaaagttgaactcaatgaatttgctcctgtatatgtctccaatcgcggttctagttttgttgcctgcagcacttataatggagccaaatgtcgtagatgtcacattgacgcttgcaaaggaccataaatcaatgtggctacttctttttctaaactcagtcatagcgtatgcagcaaacttaacaaacttcttggtgactaaacataccagtgctctcacactccaggtattaggcaatgcaaaaggtgccgtagctgttgtaatctcaatactcctattcagaaaccctgtcactgttcttggcatgggtggctatacaattaccgtgatgggagtagctgcatatggagaaacaaaaaggaggtttagatga

SEQ ID NO: 132 - protein, 308 aa, Glycine max
MSPNSKENLFIVFLVTLWYSSNIGVILLNKYLLSNYGFKFPIFLTMCHMSACAVLSYISIVFFKVVPQQMIKSRSQFIKIATLSLVFCASVVGGNISLKYLAVSFNQAVGATTPFFTAVFAYLATLKREAWVTYGALIPVVAGVVIASGGEPGFHLFGFIMCLSATAARAFKSVLQSILLSSEGEKLNSMNLLLYMSPIAVLVLLPAALIMEPNVVDVTLTLAKDHKSMWLLLFLNSVIAYAANLTNFLVTKHTSALTLQVLGNAKGAVAVVISILLFRNPVTVLGMGGYTITVMGVAAYGETKRRFR

SEQ ID NO: 133 - DNA, 1035 bp, Arabidopsis thaliana
  CDS (1)..(1035)
atgaagatagcggccaatggccggtttttcacaatcggactcgtagcgtcatggtattcatcgaacatcggagttttattgctgaacaagtacttgttaagcaactatggattcaagtatccgatcttcctcaccatgtgtcacatgacggcttgttctcttctcagctacgttgctattgcttggatgaagatggttccgatgcaaacgatccgatctcgagttcagtttcttaagatcgctgcgttaagtctcgttttctgtgtgtcggtggtttttgggaatatctctcttcggtttcttcctgtatcgtttaatcaagcgattggtgctacgacgccgtttttcaccgccgtgtttgcttatctgattacttttaagagagaagcttggttgacttacttcactctcgtccctgttgttaccggtgttgtcattgccagtgggaaacatccttgggatttgcctgagcttgatcacttcatgatatgtagtttatatgctgctcaaattagactagaagttgttcttttatgcgtgcatagtgtgaatcctagtgagccaagtttccacctgtttggattcattatgtgcattgcagctacagctgcaagagcacttaaatcagttcttcaaggaattttgctttcttcagaaggggagaagctaaattccatgaacctcctcctttacatggctcccatagctgttgtgttcctccttcctgctacacttatcatggaaaaaaatgttgttggcattacaattgcacttgccagagacgattttagaatcgtttggtatctgctattcaattcggcgctagcttattttgtgaacttgaccaatttcttagtcacgaaacacaccagcgctctgactctccaggtgctaggaaacgccaaaggtgcagtagcagtggtggtatcaatcctgatattcaggaatcctgtctcagtgactggaatgttaggttactcgctcactgtctgtggagttatcctctacagcgaagccaagaaacgaagcaaataa

SEQ ID NO: 134 - protein, 344 aa, Arabidopsis thaliana
MKIAANGRFFTIGLVASWYSSNIGVLLLNKYLLSNYGFKYPIFLTMCHMTACSLLSYVAIAWMKMVPMQTIRSRVQFLKIAALSLVFCVSVVFGNISLRFLPVSFNQAIGATTPFFTAVFAYLITFKREAWLTYFTLVPVVTGVVIASGKHPWDLPELDHFMICSLYAAQIRLEVVLLCVHSVNPSEPSFHLFGFIMCIAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFRNPVSVTGMLGYSLTVCGVILYSEAKKRSK

SEQ ID NO: 135 - DNA, 924 bp, Arabidopsis thaliana
  CDS (1)..(924)
atggcgacgaatggccggtttttcacaatcgggctagtcgcgtcttggtactcatcgaacattggtgtattgttgctgaacaagtacttgcttagcaattacggattcaagtacccgatctttctcaccatgtgtcacatgacggcttgttcgttactcagctacgtcgccattgcttggttgaagatggttccgatgcagacgattcgatccagagttcagttctttaagatcgcagctctaagtctcgttttttgtgtgtcggtggtctttggtaacatctctctccgctttcttcctgtttcgtttaaccaagccattggtgctacgacgccgtttttcaccgccgtgtttgcttacctgatgacgcgtaagaaagaggcttggttgacttacttcactctcgtccctgtcgtcaccggagttgttattgctagtgggggtgagccaagctttcacctgtttggattccttatgtgcattgcagcaacagctgcgagagcacttaaatcagtgcttcaaggaattttgctttcttctgaaggggaaaagctgaactccatgaatctcctcctttacatggctccaatagctgtcgtgctccttctgcctgctactcttatcatggagaaaaatgttgtcggcattacaattgcacttgcaagagatgatttcagaatcgtttggtatcttctattcaattcagcgctcgcctatttagtcaacttgacaaatttcttagtcacaaaccacactagcgccctgactttacaggtgctaggaaacgccaaaggagcagtagcagtggtggtctctattctaatcttcaagaatccggtgtcagtgaccggaatgctgggttactccctcaccgtctgtggagttatcctgtacagcgaagccaagaaacgaaacaaaaattag

SEQ ID NO: 136 - protein, 307 aa, Arabidopsis thaliana
MATNGRFFTIGLVASWYSSNIGVLLLNKYLLSNYGFKYPIFLTMCHMTACSLLSYVAIAWLKMVPMQTIRSRVQFFKIAALSLVFCVSVVFGNISLRFLPVSFNQAIGATTPFFTAVFAYLMTRKKEAWLTYFTLVPVVTGVVIASGGEPSFHLFGFLMCIAATAARALKSVLQGILLSSEGEKLNSMNLLLYMAPIAVVLLLPATLIMEKNVVGITIALARDDFRIVWYLLFNSALAYLVNLTNFLVTNHTSALTLQVLGNAKGAVAVVVSILIFKNPVSVTGMLGYSLTVCGVILYSEAKKRNKN

SEQ ID NO: 137 - DNA, 1650 bp, Zea mays
  CDS (104)..(1078)
accaaacccaccagcacagcaccaattcaaccgcgacccaacccaccgccccgcaccccattcccgcaccctcctcccccagatctccggccgcgacgacgccatgacggccaagggcggcgccacgccgtcccccggcggcgcgggccccgcggcggggaacggccgcctcttcaccgtcgggctcgtcaccgcctggtactcctccaacatcggcgtgctcctgctcaacaagtacctcctcagcaactacggcttcaagtaccccatcttcctcaccatgtgccacatgtccgcctgcgccctcctctcctacgccgccatcgcctggctccgcatcgtgcccatgcagctcgtgcgctcccgcgtccagctcgccaagatcgccgccctcagcctcgtcttctgcggctccgtcgtctccggcaacgtctcgctccgctacctccccgtctccttcaaccaggccgtcggcgccaccacgcctttcttcaccgccgtcttcgcctacatcatgaccgtcaagcgcgagtcctgggtcacctacctcaccctcgtgcccgtcgtcaccggagtcatcatcgccagcggcggcgagcctagctttcatctgtttggattcatcatgtgcataggagcaactgcagcaagggcgttgaagacagtattgcaaggaattcttctgtcttccgatggggagaagcttaattctatgaatctgttgttgtacatggctccaatcgctgttatcttcttgcttcctgcaactatctttatggaggataatgttgtcggcgttacaattgagcttgcaaagaaggatttcacgattgtttggttgcttttgttcaattcttgcttgtcgtattttgtcaatttgaccaatttcttggtgaccaagcatactagtgcactgactctacaggttctcggaaatgcaaagggtgcggtggcagttgtcgtctcgattatgatattcaggaatcccgtgtccataacaggaatgctcggttatactctcacagtttttggcgtcattctttacagtgaatcgaaaaagcgcagcaacaagccatgaataccctaggagacagtaaatatgggaaatcatttctttgtcctgtcagtgcctagagctaatatatgatgagaaatcacatcggtggcgaccacaacaaatcctatgccatactgcctcagcaattggacatcaaggatagaagtccaataactaccttggcatatgggaggcattttgttttatggcgttgatggatagaatataaatatttttttgtgtgtgttagagaactatggctcacactgccagcattggttgatacgtttagctcttgggaaattgcctcttgtattcatcttctgctgctgcagtttccattttgttttgttgtgaagaccacctataccacactttgatccaggttccgggacctaattaatatattgtgacactgaattgatgctcaaaaaaaaaaaaaaaggtgacacaatgttgtcccatcatgactgccaatgtaaagtctacatgactacatagctacattgttggttcagatttgcatgcaactgcccagctgttttgactgtgaaaaaaaaaaaaaaaaaaactcgaactatctctcctcgtgc

SEQ ID NO: 138 - protein, 324 aa, Zea mays
MTAKGGATPSPGGAGPAAGNGRLFTVGLVTAWYSSNIGVLLLNKYLLSNYGFKYPIFLTMCHMSACALLSYAAIAWLRIVPMQLVRSRVQLAKIAALSLVFCGSVVSGNVSLRYLPVSFNQAVGATTPFFTAVFAYIMTVKRESWVTYLTLVPVVTGVIIASGGEPSFHLFGFIMCIGATAARALKTVLQGILLSSDGEKLNSMNLLLYMAPIAVIFLLPATIFMEDNVVGVTIELAKKDFTIVWLLLFNSCLSYFVNLTNFLVTKHTSALTLQVLGNAKGAVAVVVSIMIFRNPVSITGMLGYTLTVFGVILYSESKKRSNKP

SEQ ID NO: 139 - DNA, 1225 bp, Brassica napus
  CDS (35)..(1120)
ctcagacaagaaaaaaaaactctctctaaccaaaatggtggaagctcaatcatggacgacgcggcggatgagcaacccgaggttcgacgccgccgccaccaccacaccaacagtcatcgacatccccggaacacctccacactcctccgcttcctccaatggaaaacctttcttcctctcgtcaccaacagtatcgccctccgtcctcacggcggcgataatcgccgcctggttcggctccaacataggagtcctcctcctgaacaagtacctcctcttctactacggcttccgctacccgatcttcttgaccatgacgcacatgctctcctgcgccgcctacagctccgccgtcatcaacatcgccggaatcgtgccgcgtcagcacatcctctcccgccgtcagtttctgaagattcttgcactctcggcgatcttttgcctctccgtcgtgtgcggcaacacttcgctccgttacatccctgtttcttttaatcaagcgatcggagccaccacgccgttcttcaccgccgtcttctctttcctcattacctgtaaaacagagtccactgaagtttacttggctctgcttcccgtcgtttccgggatagttctcgcttctaactccgagccttcgtttcatctctttggtttcctcatttgcgtcgcttccaccgccggtagagctcttaaatccgtcgtccaggggattattctgacttcggaatctgagaagctacattcgatgaatcttctgctctacatggctccaatggcagcttgtatcttattaccatttacactctacattgaaggaaacgtattaagaatcctaatcgaaaaggcgaggaccgatccattgatcatcttcttgctcgcagggaatgccacagtggcatatttagtaaatttgacgaacttcttggtgactaagcacacaagtgctctcaccttgcaggttttaggcaacggaaaggctgcggtggctgccggagtctcggttttgatatttaggaatccggtgacgatgatgggtgttgccggatttggagtcacgattatgggagtggttctctacagcgaagctaggaagagatccaagttgcttaaccagaagtaaaatgtgaaagtggggaaagaaactggatttaaaccggtgaagtaatttcttattttatggtatttttcggttaaagtatcttgattcttcgaaaaaaaaaaaaaa

SEQ ID NO: 140 - protein, 361 aa, Brassica napus
MVEAQSWTTRRMSNPRFDAAATTTPTVIDIPGTPPHSSASSNGKPFFLSSPTVSPSVLTAAIIAAWFGSNIGVLLLNKYLLFYYGFRYPIFLTMTHMLSCAAYSSAVINIAGIVPRQHILSRRQFLKILALSAIFCLSVVCGNTSLRYIPVSFNQAIGATTPFFTAVFSFLITCKTESTEVYLALLPVVSGIVLASNSEPSFHLFGFLICVASTAGRALKSVVQGIILTSESEKLHSMNLLLYMAPMAACILLPFTLYIEGNVLRILIEKARTDPLIIFLLAGNATVAYLVNLTNFLVTKHTSALTLQVLGNGKAAVAAGVSVLIFRNPVTMMGVAGFGVTIMGVVLYSEARKRSKLLNQK

SEQ ID NO: 141 - DNA, 1302 bp, Brassica napus
  CDS (123)..(1058)
taattcgtgagccagaggacgagacaatcaaaatgctccaagtgaggacctgatttatctcgtttctctctctttctctcaacggatctcgatctcgccgaggaagaagaagaagaagaacaatgtcgtcttcctcctcatcaaagaagcaaaccctcttcatatcgaccctcatcatctcatggtactcctccaacatcggcgtcctcctcctcaacaagttcctcctctccaactacggcttcaagttccccatcttcctcaccatgtgccacatgtccgcctgcgccttcctcagctacatctccatcgtcttcctcaagctcgtccctctccagcacctcaaatctcgctcccagttcctcaaggtcgccactctcagcgtcgtcttctgcgcctccgtcgtcggcggtaacatctcgctccgttacctccccgtctctttcaatcaagccgtcggtgctacgacgccgtttttcaccgcgctcttcgcgtatctcatgactcttaagagagaggcttgggttacctatggtgctcttgtccctgtcgttgctggtgtcgtcattgctagtgggggtgagccagggtttcactggttcggtttcataatgtgcattagtgctacagctgcaagagcctttaaatctgttcttcaaggcatcttactttcttcagaaggggaaaaattgaactcgatgaatttgatgctgtacatgtctccgatagctgtggttgctcttcttccggtgacgctagttatggaaccagacgtgatcagcctgaccttgacgcttgcaaagcaacatcagtacatgtggatacttctcctggtcaactccgtaatggcttattcagccaatctgttgaattttctagttacaaaacacacaagcgccctcactctccaggttcttggaaatgctaaaggagcagttgcggtggtgatatccatcttgatctttcaaaacccggttacggttatgggaattggcgggtactccataacggttcttggggtggttgcttacggagagacaaaacgcagattcagatgaactattcagtttcagcaacatagcgcgcttcacactccctatgtttggttcttcatctgtttttttttatcaagactcattaattagtgaatttttttttgtaactatttcttattaatatacgcactatatagaattatatgtatcagactttagattctatgatgagaagccattgttgtttaaaaaaaaaaaaaaaaaaaaaaaaaaaaaaaaaaaaaaaaaaaaaaaaaaaaaaaaaaaa

SEQ ID NO: 142 - protein, 311 aa, Brassica napus
MSSSSSSKKQTLFISTLIISWYSSNIGVLLLNKFLLSNYGFKFPIFLTMCHMSACAFLSYISIVFLKLVPLQHLKSRSQFLKVATLSVVFCASVVGGNISLRYLPVSFNQAVGATTPFFTALFAYLMTLKREAWVTYGALVPVVAGVVIASGGEPGFHWFGFIMCISATAARAFKSVLQGILLSSEGEKLNSMNLMLYMSPIAVVALLPVTLVMEPDVISLTLTLAKQHQYMWILLLVNSVMAYSANLLNFLVTKHTSALTLQVLGNAKGAVAVVISILIFQNPVTVMGIGGYSITVLGVVAYGETKRRFR

SEQ ID NO: 143 - DNA, 933 bp, Brassica napus
  CDS (1)..(933)
atgaagatggcggcggcggggaacggccggttcttcacaatcgggctcgtggcgtcgtggtactcgtccaacatcggagtgctactactaaacaagtacctgctgagcaactacgggttcaagtacccgatcttcctcacgatgtgccacatgacggcgtgctcgctcctcagctacgtggccatcgcgtggatgaagatggtccctatgcagacgatcaggtcccgcgtccagttcctcaagatcgcggcgctgagcctcgtcttctgcgtctccgtggtgttcgggaacatttcgctgaggtttcttccggtttcgtttaaccaggccatcggcgccacgacgccgtttttcacggccgtgtttgcgtatttgattacgttgaagaaggaggcgtggttgacttatgttacgctcgtgcccgttgttactggtgttgttattgctagtgggagtgaaccaagcttccacctgtttggattcattatgtgcgttgcagccacggctgcgagagcacttaaatcagttcttcaagggattttgctatcttcagaaggggagaagctaaactccatgaatctactcctctacatggctcccatagctgttgtgttccttcttcctgctacccttatcatggagaagaacgtcgttggcattacaattgcactcgccagagacgatttcagaatcgtttggtatctgctatttaattcggcgcttgcttatttcgtgaacttgactaacttcttagtcacaaaacacaccagcgctctgactctccaggtgctaggaaacgccaaaggagcagtagcagtggtggtatcgattttaatattcaagaatcctgtctcagtgactggaatgttaggctactcgctaacggtcattggagttatcctctacagtgaagccaagaaacgaagcaaatga

SEQ ID NO: 144 - protein, 310 aa, Brassica napus
MKMAAAGNGRFFTIGLVASWYSSNIGVLLLNKYLLSNYGFKYPIFLTMCHMTACSLLSYVAIAWMKMVPMQTIRSRVQFLKIAALSLVFCVSVVFGNISLRFLPVSFNQAIGATTPFFTAVFAYLITLKKEAWLTYVTLVPVVTGVVIASGSEPSFHLFGFIMCVAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFKNPVSVTGMLGYSLTVIGVILYSEAKKRSK

SEQ ID NO: 145 - DNA, 975 bp, Zea mays
  CDS (1)..(975)
atgacggccaagggcggcgccacgccgtcccccggcggcgcgggccccgcggcggggaacggccgcctcttcaccgtcgggctggtcaccgcctggtactcctccaacatcggcgtgctcctgctcaacaagtacctcctcagcaactacggcttcaagtaccccatcttcctcaccatgtgccacatgtccgcctgcgccctgctctcctacgccgccatcgcctggctgcgcgtcgtgcccatgcagctcgtgcgctcccgcgtccagctcgccaagatcgccgcgctcagcctcgtcttctgcggctccgtcgtctccggcaacgtctcgctgcgctacctccccgtctccttcaaccaggcggtcggcgccaccacgcctttcttcaccgccgtcttcgcctacatcatgaccgtcaagcgcgagtcctgggtcacctacctcaccctcgtgcccgtcgtcaccggagtcatcatcgccagcggcggcgagcctagctttcatctgtttggattcatcatgtgcataggagcaactgcagcaagggcgttgaagacagtattgcaaggaattcttctgtcttccgatggggagaagcttaattctatgaatctgttgttgtacatggctccaatcgctgttatcttcttgcttcctgcaactatctttatggaggataatgttgtcggcgttacaattgagcttgcaaagaaggatttcacgattgtttggttgcttttgttcaattcttgcttgtcgtattttgtcaatttgaccaatttcttggtgaccaagcatactagtgcactgactctacaggttctcggaaatgcaaagggtgccgtggcagttgtcgtctcgattatgatattcaggaatcccgtgtccataacaggaatgctcggttatactctcacagtttttggcgtcattctttacagcgaatccaaaaagcgcagcaacaagccatga

SEQ ID NO: 146 - protein, 324 aa, Zea mays
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVIIASGGEPSFHLFGFIMCIGATAARALKTVLQGILLSSDGEKLNSMNLLLYMAPIAVIFLLPATIFMEDNVVGVTIELAKKDFTIVWLLLFNSCLSYFVNLTNFLVTKHTSALTLQVLGNAKGAVAVVVSIMIFRNPVSITGMLGYTLTVFGVILYSESKKRSNKP

SEQ ID NO: 147 - DNA, 1239 bp, Zea mays
  CDS (132)..(1106)
gggtcgacttcgctgtcgacgatttcgtaccaaacccaccagcacagcaccaattcaaccgcgacccaacccaccgccccgcaccccattcccgcaccctcctcccccagatctccggccgcgacgacgccatgacggccaagggcggcgccacgccgtcccccggcggcgcgggccccgcggcggggaacggccgcctcttcaccgtcgggctggtcaccgcctggtactcctccaacatcggcgtgctcctgctcaacaagtacctcctcagcaactacggcttcaagtaccccatcttcctcaccatgtgccacatgtccgcctgcgccctgctctcctacgccgccatcgcctggctgcgcgtcgtgcccatgcagctcgtgcgcttccgcgtccagctcgccaagatcgccgcgctcagcctcgtcttctgcggctccgtcgtctccggcaacgtctcgctgcgctacctccccgtctccttcaaccaggcggtcggcgccaccacgcctttcttcaccgccgtcttcgcctacatcatgaccgtcaagcgcgagtcctgggtcacctacctcaccctcgtgcccgtcgtcaccggagtcatcatcgccagcggcggcgagcctagctttcatctgtttggattcatcatgtgcataggagcaactgcagcaagggcgttgaagacagtactgcaaggaattcttctgtcttctgatggggagaagcttaattctatgaatctgttattgtacatggctccaattgctgttattttcttgcttcctgcaactatctttatggaggataatgttgttggcatcacaattcagcttgcaaagaaggatttcacgattgtttggttgctactgttcaattcttgcttgtcatattttgtcaatttgaccaatttcttggtgaccaaacatactagcgcactgactctacaggttctcggaaatgcaaagggtgccgtggcagtcgtcatctcaatcatgatattcaggaatcctgtgtccataacaggaatgctcggttacactctcacagtttttggcgtcattctttacagtgaatccaaaaagcgcagcaacaagccgtgaccaccctagaagacagtaaatacggccatcatttctttgtcctgccagcgcctagagctaatatatgatgagaaactacaccggtggcgatcacaacaaatccaatgccgtaccgcctcagcaattggacatc

SEQ ID NO: 148 - protein, 324 aa, Zea mays
MTAKGGATPSPGGAGPAAGNGRLFTVGLVTAWYSSNIGVLLLNKYLLSNYGFKYPIFLTMCHMSACALLSYAAIAWLRVVPMQLVRFRVQLAKIAALSLVFCGSVVSGNVSLRYLPVSFNQAVGATTPFFTAVFAYIMTVKRESWVTYLTLVPVVTGVIIASGGEPSFHLFGFIMCIGATAARALKTVLQGILLSSDGEKLNSMNLLLYMAPIAVIFLLPATIFMEDNVVGITIQLAKKDFTIVWLLLFNSCLSYFVNLTNFLVTKHTSALTLQVLGNAKGAVAVVISIMIFRNPVSITGMLGYTLTVFGVILYSESKKRSNKP

SEQ ID NO: 149 - protein, 329 aa, Artificial sequence
  Description of artificial sequence: consensus sequence
  Variant (2)..(3): Xaa in position 2 to 3 is any amino acid
  Variant (6)..(6): Xaa in position 6 is any amino acid
  Variant (25)..(26): Xaa in position 25 to 26 is any amino acid
  Variant (36)..(36): Xaa in position 36 is any amino acid
  Variant (39)..(41): Xaa in position 39 to 41 is any amino acid
  Variant (43)..(43): Xaa in position 43 is any amino acid
  Variant (45)..(46): Xaa in position 45 to 46 is any amino acid
  Variant (48)..(52): Xaa in position 48 to 52 is any amino acid
  Variant (55)..(55): Xaa in position 55 is any amino acid
  Variant (57)..(59): Xaa in position 57 to 59 is any amino acid
  Variant (62)..(62): Xaa in position 62 is any amino acid
  Variant (64)..(65): Xaa in position 64 to 65 is any amino acid
  Variant (68)..(69): Xaa in position 68 to 69 is any amino acid
  Variant (72)..(72): Xaa in position 72 is any amino acid
  Variant (76)..(76): Xaa in position 76 is any amino acid
  Variant (80)..(80): Xaa in position 80 is any amino acid
  Variant (83)..(83): Xaa in position 83 is any amino acid
  Variant (87)..(87): Xaa in position 87 is any amino acid
  Variant (96)..(96): Xaa in position 96 is any amino acid
  Variant (110)..(111): Xaa in position 110 to 111 is any amino acid
  Variant (113)..(113): Xaa in position 113 is any amino acid
  Variant (115)..(115): Xaa in position 115 is any amino acid
  Variant (117)..(117): Xaa in position 117 is any amino acid
  Variant (119)..(119): Xaa in position 119 is any amino acid
  Variant (122)..(123): Xaa in position 122 to 123 is any amino acid
  Variant (125)..(125): Xaa in position 125 is any amino acid
  Variant (129)..(129): Xaa in position 129 is any amino acid
  Variant (132)..(132): Xaa in position 132 is any amino acid
  Variant (137)..(137): Xaa in position 137 is any amino acid
  Variant (138)..(173): Xaa in position 138 to 173 is any or no amino acid
  Variant (186)..(187): Xaa in position 186 to 187 is any amino acid
  Variant (194)..(194): Xaa in position 194 is any amino acid
  Variant (196)..(196): Xaa in position 196 is any amino acid
  Variant (200)..(200): Xaa in position 200 is any amino acid
  Variant (206)..(206): Xaa in position 206 is any amino acid
  Variant (225)..(226): Xaa in position 225 to 226 is any amino acid
  Variant (230)..(230): Xaa in position 230 is any amino acid
  Variant (232)..(233): Xaa in position 232 to 233 is any amino acid
  Variant (236)..(236): Xaa in position 236 is any amino acid
  Variant (239)..(241): Xaa in position 239 to 241 is any amino acid
  Variant (243)..(244): Xaa in position 243 to 244 is any amino acid
  Variant (247)..(248): Xaa in position 247 to 248 is any amino acid
  Variant (250)..(255): Xaa in position 250 to 255 is any amino acid
  Variant (258)..(258): Xaa in position 258 is any amino acid
  Variant (261)..(263): Xaa in position 261 to 263 is any amino acid
  Variant (265)..(265): Xaa in position 265 is any amino acid
  Variant (296)..(296): Xaa in position 296 is any amino acid
  Variant (299)..(299): Xaa in position 299 is any amino acid
  Variant (302)..(302): Xaa in position 302 is any amino acid
  Variant (306)..(308): Xaa in position 306 to 308 is any amino acid
  Variant (311)..(311): Xaa in position 311 is any amino acid
  Variant (314)..(315): Xaa in position 314 to 315 is any amino acid
  Variant (318)..(318): Xaa in position 318 is any amino acid
  Variant (321)..(321): Xaa in position 321 is any amino acid
  Variant (324)..(324): Xaa in position 324 is any amino acid
  Variant (326)..(326): Xaa in position 326 is any amino acid
VXXWYXSNIGVLLLNKYLLSNYGFXXPIFLTMCHMXACXXXSXYXXIXXXXXVPXQXXXSRXQXXKIXXLSXVFCXSVVXGNXSLRXLPVSFNQAXGATTPFFTAVFAYXXTXKXEXWXTYXXLXPVVXGVXIASGXXXXXXXXXXXXXXXXXXXXXXXXXXXXXXXXXXXXXEPSFHLFGFIMCXXATAARAXKXVLQXILLSSXGEKLNSMNLLLYMAPIAVXXLLPXTXXMEXNVXXXTXXLAXXDXXXXXXLLXNSXXXYXVNLTNFLVTKHTSALTLQVLGNAKGAVAVVXSIXIFXNPVXXXGMXGYXXTVXGVXLYXEXKKR

SEQ ID NO: 150 - protein, 60 aa, Artificial sequence
  Description of artificial sequence: amino acid sequence pattern comprised in a variant of SEQ ID NO: 88
  Variant (4)..(4): Xaa in position 4 is Ala or Thr
  Variant (7)..(7): Xaa in position 7 is Ile, Met or Val
  Variant (12)..(12): Xaa in position 12 is Gly or Ser
  Variant (15)..(15): Xaa in position 15 is Gly or Ser
  Variant (18)..(18): Xaa in position 18 is any amino acid
  Variant (23)..(23): Xaa in position 23 is Ile or Met
  Variant (25)..(25): Xaa in position 25 is Ile, Leu or Val
  Variant (26)..(26): Xaa in position 26 is Ala, Gly or Ser
  Variant (27)..(27): Xaa in position 27 is Ala or Ser
  Variant (29)..(29): Xaa in position 29 is Ala or Gly
  Variant (33)..(33): Xaa in position 33 is Phe or Leu
  Variant (35)..(35): Xaa in position 35 is Ser or Thr
  Variant (37)..(37): Xaa in position 37 is any amino acid
  Variant (38)..(38): Xaa in position 38 is Asp or Gln
  Variant (39)..(39): Xaa in position 39 is Asp, Gly, Ser or Val
  Variant (40)..(40): Xaa in position 40 is Ile or Val
  Variant (41)..(41): Xaa in position 41 is Ile or Leu
  Variant (45)..(45): Xaa in position 45 is Asp or Glu
  Variant (48)..(48): Xaa in position 48 is Lys or Arg
  Variant (55)..(55): Xaa in position 55 is Leu or Met
  Variant (59)..(59): Xaa in position 59 is Ala or Ser
PVVXGVXIASGXEPXFHXFGFIXCXXXTXARAXKXVXXXXXLSSXGEXLNSMNLXLYMXP

SEQ ID NO: 151 - protein, 57 aa, Artificial sequence
  Description of artificial sequence: amino acid sequence pattern comprised in a variant of SEQ ID NO: 88
  Variant (24)..(24): Xaa in position 24 is Ile or Val
  Variant (27)..(27): Xaa in position 27 is Leu or Met
  Variant (28)..(28): Xaa in position 28 is Ile or Leu
  Variant (30)..(30): Xaa in position 30 is any amino acid
  Variant (33)..(33): Xaa in position 33 is Ile or Val
  Variant (34)..(34): Xaa in position 34 is Ser or Thr
  Variant (35)..(35): Xaa in position 35 is Ile, Met or Val
  Variant (36)..(36): Xaa in position 36 is any amino acid
  Variant (38)..(38): Xaa in position 38 is Ile or Met
  Variant (39)..(39): Xaa in position 39 is Gly or Leu
  Variant (42)..(42): Xaa in position 42 is Ala, Ser or Thr
  Variant (43)..(43): Xaa in position 43 is Ile or Leu
  Variant (45)..(45): Xaa in position 45 is Ile or Val
  Variant (46)..(46): Xaa in position 46 is any amino acid
  Variant (49)..(49): Xaa in position 49 is Ala, Ile or Val
  Variant (50)..(50): Xaa in position 50 is Ala or Leu
  Variant (52)..(52): Xaa in position 52 is Gly or Ser
  Variant (54)..(54): Xaa in position 54 is Ala, Ser or Thr
  Variant (56)..(56): Xaa in position 56 is Lys or Arg
VTKHTSALTLQVLGNAKGAVAVVXSIXXFXNPXXXXGXXGYXXTXXGVXXYXEXKXR

SEQ ID NO: 152 - protein, 59 aa, Artificial sequence
  Description of artificial sequence: amino acid sequence pattern comprised in a variant of SEQ ID NO: 88
  Variant (3)..(4): Xaa in position 3 to 4 is any or no amino acid
  Variant (6)..(6): Xaa in position 6 is Phe or Leu
  Variant (7)..(7): Xaa in position 7 is any amino acid
  Variant (8)..(8): Xaa in position 8 is Lys or Arg
  Variant (9)..(9): Xaa in position 9 is Ile or Val
  Variant (10)..(10): Xaa in position 10 is Ala, Ser or Val
  Variant (11)..(11): Xaa in position 11 is any amino acid
  Variant (13)..(13): Xaa in position 13 is Gly or Ser
  Variant (14)..(14): Xaa in position 14 is Ala, Ile, Leu or Val
  Variant (18)..(18): Xaa in position 18 is any amino acid
  Variant (22)..(22): Xaa in position 22 is any amino acid
  Variant (25)..(25): Xaa in position 25 is Ile or Val
  Variant (28)..(28): Xaa in position 28 is Lys or Arg
  Variant (29)..(29): Xaa in position 29 is Phe, His or Tyr
  Variant (30)..(30): Xaa in position 30 is Ile or Leu
  Variant (31)..(31): Xaa in position 31 is Ala or Pro
  Variant (38)..(38): Xaa in position 38 is Ile or Val
  Variant (48)..(48): Xaa in position 48 is Leu or Val
  Variant (49)..(49): Xaa in position 49 is Phe or Leu
  Variant (52)..(52): Xaa in position 52 is Ala, Ile or Leu
  Variant (53)..(53): Xaa in position 53 is any amino acid
  Variant (54)..(54): Xaa in position 54 is Ala, Ser or Thr
  Variant (55)..(55): Xaa in position 55 is any amino acid
  Variant (56)..(57): Xaa in position 56 to 57 is Lys or Arg
  Variant (59)..(59): Xaa in position 59 is Ala or Ser
RSXXQXXXXXXLXXVFCXSVVXGNXSLXXXXVSFNQAXGATTPFFTAXXAYXXXXXXEX

SEQ ID NO: 153 - protein, 21 aa, Artificial sequence
  Description of artificial sequence: amino acid sequence pattern comprised in a variant of SEQ ID NO: 88
  Variant (3)..(3): Xaa in position 3 is Phe or Tyr
  Variant (11)..(11): Xaa in position 11 is Lys or Arg
  Variant (12)..(12): Xaa in position 12 is Phe or Tyr
  Variant (14)..(14): Xaa in position 14 is Ile or Val
  Variant (18)..(18): Xaa in position 18 is any amino acid
NKXLLSNYGFXXPXFLTXCHM

SEQ ID NO: 154 - protein, 20 aa, Artificial sequence
  Description of artificial sequence: amino acid sequence pattern comprised in a variant of SEQ ID NO: 88
  Variant (2)..(3): Xaa in position 2 to 3 is any amino acid
  Variant (4)..(4): Xaa in position 4 is any or no amino acid
  Variant (7)..(7): Xaa in position 7 is any amino acid
  Variant (8)..(8): Xaa in position 8 is Asp or Asn
  Variant (10)..(10): Xaa in position 10 is Ile, Met or Val
  Variant (11)..(11): Xaa in position 11 is Gly, Gln or Ser
  Variant (12)..(12): Xaa in position 12 is Ile, Leu or Val
  Variant (14)..(14): Xaa in position 14 is Ile, Leu or Met
  Variant (15)..(15): Xaa in position 15 is Ala, Asp, Glu, Gln or Thr
  Variant (17)..(17): Xaa in position 17 is Ala or Gly
  Variant (18)..(18): Xaa in position 18 is Lys or Arg
  Variant (19)..(19): Xaa in position 19 is any amino acid
  Variant (20)..(20): Xaa in position 20 is Asp or His
TXXXMEXXVXXXTXXLXXXX

SEQ ID NO: 155 - protein, 12 aa, Artificial sequence
  Description of artificial sequence: amino acid sequence pattern comprised in a variant of SEQ ID NO: 88
  Variant (3)..(3): Xaa in position 3 is any or no amino acid
  Variant (5)..(5): Xaa in position 5 is any or no amino acid
WYXSXNIGVLLL

SEQ ID NO: 156 - protein, 14 aa, Artificial sequence
  Description of artificial sequence: amino acid sequence pattern comprised in a variant of SEQ ID NO: 88
  Variant (3)..(3): Xaa in position 3 is any amino acid
  Variant (4)..(4): Xaa in position 4 is any or no amino acid
  Variant (6)..(6): Xaa in position 6 is Ala or Ser
  Variant (7)..(7): Xaa in position 7 is Ala, Cys, Thr or Val
  Variant (8)..(8): Xaa in position 8 is Ile, Leu, Met or Val
  Variant (9)..(9): Xaa in position 9 is Ala or Ser
  Variant (11)..(11): Xaa in position 11 is any amino acid
  Variant (12)..(12): Xaa in position 12 is Ala or Val
LLXXNXXXXYXXNL

SEQ ID NO: 157 - protein, 14 aa, Artificial sequence
  Description of artificial sequence: amino acid sequence pattern comprised in a variant of SEQ ID NO: 88
  Variant (2)..(2): Xaa in position 2 is any amino acid
  Variant (3)..(3): Xaa in position 3 is Ala, Ile or Val
  Variant (4)..(4): Xaa in position 4 is Ala, Ser or Val
  Variant (6)..(6): Xaa in position 6 is Ala, Asn or Val
  Variant (7)..(10): Xaa in position 7 to 10 is any amino acid
  Variant (13)..(13): Xaa in position 13 is any amino acid
SXXXIXXXXXVPXQ

SEQ ID NO: 158 - DNA, 1212 bp, Arabidopsis thaliana
  CDS (1)..(1212)
atggcaacagcaacatcagcttctctgttttcaactgtttcttcatcttactccaaagctagctccataccacattcaagactccaatctgtgaaattcaactcagtccctagcttcaccggtctcaaatcaacctctctcatctccggatctgattcctcttccttagccaagactctacgcggttccgtaacgaaagcacaaacatctgacaagaagccttacggattcaaaatcaacgcttcatacaaagtagctgttcttggtgctgctggtggtataggtcagcctttatcacttctcatcaagatgtctccgttagtctctacgcttcatctttacgatatcgccaatgttaaaggagttgctgctgatctaagtcattgtaacactccttctcaagttcgtgatttcactggtccttctgagttagctgattgtttgaaagatgttaacgttgttgtcatccctgctggtgtgccgaggaaacccggtatgactcgtgacgatcttttcaacatcaatgccaatattgtcaagactcttgttgaagctgttgctgagaattgccctaatgctttcattcatattattagtaacccggttaactctacggtacctattgctgctgaagtgttgaagaagaaaggtgtttatgatcctaagaagctgtttggtgtcactactttggatgttgtgagggctaacacttttgtttctcagaagaagaatcttaagcttattgatgttgatgttccggttattggtggacatgctggaatcaccattttgcctctcctctcgaagacaaaaccgtctgttaactttactgatgaagagatccaagagctcactgttaggattcagaacgctggtactgaggttgttgatgctaaggcaggtgcaggttcagctactttgtcaatggcttatgctgctgctagatttgtagagtcatctcttcgtgctcttgatggagacggagatgtctacgagtgctcgtttgtggagtcgactctgactgatcttcctttctttgcatcacgggttaagatagggaagaacggtcttgaagctgtgattgagtcagaccttcagggattgactgagtatgagcagaaagcactagaagctcttaaggtagaattgaaagctagcattgacaagggtgtcgcatttgcaaacaaaccagctgctgcagcagctaactag

SEQ ID NO: 159 - protein, 403 aa, Arabidopsis thaliana
MATATSASLFSTVSSSYSKASSIPHSRLQSVKFNSVPSFTGLKSTSLISGSDSSSLAKTLRGSVTKAQTSDKKPYGFKINASYKVAVLGAAGGIGQPLSLLIKMSPLVSTLHLYDIANVKGVAADLSHCNTPSQVRDFTGPSELADCLKDVNVVVIPAGVPRKPGMTRDDLFNINANIVKTLVEAVAENCPNAFIHIISNPVNSTVPIAAEVLKKKGVYDPKKLFGVTTLDVVRANTFVSQKKNLKLIDVDVPVIGGHAGITILPLLSKTKPSVNFTDEEIQELTVRIQNAGTEVVDAKAGAGSATLSMAYAAARFVESSLRALDGDGDVYECSFVESTLTDLPFFASRVKIGKNGLEAVIESDLQGLTEYEQKALEALKVELKASIDKGVAFANKPAAAAAN

SEQ ID NO: 160 - DNA, 1522 bp, Brassica napus
  CDS (89)..(1285)
ctctctctcactcactcaaaccctcgaaagcctgcgaagaaaactcttgaagcgtctctatctctctcgtcttgagctttcctcaaagatggcagcaacatcagcagcttcttcgatttcaattggatcaaacctttccagagccaccagctcctcctcaagggcacaagctgttaactttaactactctctccctcgtttcaccgctctgagatcatccactctcctctctggaccagaatcctcatctttcgccaagtctctccgcggttccgtaatgaaatcccaatcaaccgacacgaagccgtacggattgaacatcaacgcatcgtacaaagtggcggtcctcggtgctgccggagggatcggtcagcctctgtcacttctcatcaaaatgtctcctctcgtctccaccctccacctctacgatatcgccaacgtcaagggagtcgccgctgatttgagccactgcaacactccctctcaggttcgtgatttcaccggaccggctgagctggctgattgtttgaaagatgtcaacgtcgttgtcatccctgctggtgtgccgagaaagcccggtatgacccgtgacgatctcttcaacatcaacgccggtatagtgaagacgcttgttgaggctgtcgctgataactgtcctaacgcgttcatccacatcatcagcaaccctgttaactccaccgtccccattgctgctgaggtgttgaagaagaaaggtgtctatgatcccaagaagctctttggtgtcaccactttggatgttgtgagggctaacacctttgtttctcagaaaaagaacttgaagctcatcgatgtcgatgttcccgtcatcggtggccacgctggaatcaccattctgcctcttctatccaagaccaagccttctgtcagcttcactgacgaagagatcgagaaactcactctgaggattcagaacgctggaaccgaggttgtggatgctaaggcgggtgctggctcggctactttgtcgatggcctatgccgcagcgagatttgtggagtcgtctcttcgtgctcttgacggagatggagatgtttacgagtgctcgttcgtggactccactctcactgatcttcctttctttgcatcacggatcaagattgggaggaacggagttgaagctgtgattgagtctgacctccaagggctgactgagtacgagcagaaggcactagaagctcttaagccagaactgaaagctagcatcgaaaagggtgttgcattcgcaaacaaacctgctaactaagatctttgatctcatctgagagaaacatgcttctacattcgagaggataacagtttccttctgatcattttgagttttgttttgttttatttttgttgcatcggcgagacattttctggttgtagaataaagaatgtattagcttcttcggttctgaagatgttggatacacgacattgaatcagattttatgatgaatcacaccaaatatcatcttggttttaaaaaaaaaaaaaa

SEQ ID NO: 161 - protein, 398 aa, Brassica napus
MAATSAASSISIGSNLSRATSSSSRAQAVNFNYSLPRFTALRSSTLLSGPESSSFAKSLRGSVMKSQSTDTKPYGLNINASYKVAVLGAAGGIGQPLSLLIKMSPLVSTLHLYDIANVKGVAADLSHCNTPSQVRDFTGPAELADCLKDVNVVVIPAGVPRKPGMTRDDLFNINAGIVKTLVEAVADNCPNAFIHIISNPVNSTVPIAAEVLKKKGVYDPKKLFGVTTLDVVRANTFVSQKKNLKLIDVDVPVIGGHAGITILPLLSKTKPSVSFTDEEIEKLTLRIQNAGTEVVDAKAGAGSATLSMAYAAARFVESSLRALDGDGDVYECSFVDSTLTDLPFFASRIKIGRNGVEAVIESDLQGLTEYEQKALEALKPELKASIEKGVAFANKPAN

SEQ ID NO: 162 - DNA, 1744 bp, Triticum aestivum
  CDS (126)..(1310)
gaattcccgggtcgacgccgccaccgccgttccccttcttccccggcctccgggacatcctgctgctgcctccaccccgtcccagtctccggccactgggtctccttccttccttcgagttggacatggcatcatctgctaccatcagttcagttggcgctcaggctgctctggtttcaaagccaaggaatcatggcatcggtggcttaaaggcgtcctcatcaattaacttcgaattgggatcctcgttcctgggcaagaccgggtctcttcgggcatctgttaccacaagggttgtgcccaaggcgaagtctggggctcggatactaccggaggcatcttacaaagtggcggtacttggtgctgctgggggcatcggccaaccattgggcctgctgatcaagatgtctcctctggtctcggagctgcgactgtacgatattgcaaatgtcaagggagtcgctgctgatctcagccactgcaacacaccttctcaggtcatggacttcactggcccagcggaattagccagctgcttgaaaggtgtggatgttgttgtcatccccgccggggtccctagaaagcctgggatgactcgtgatgatcttttcaacatcaatgcgggcatcgtcaagtcacttatcgaggctgttgcagacaattgccctgatgcctttatccatattatcagcaacccagtcaactccacagtgccgattgctgctgagattctgaaacagaagggtgtctacaatcccaagaagctttttggggtttccaccctagatgttgtccgagctaacacattcgtagctcagaagaagggcctcaagctcattgatgttgatgtcccagttgttggtggtcatgctggaattacaatcctgcctttgttgtcaaagacgaggccatctgtcaccttcacggatgaggaaactgaacagctgacgaagaggatacagaacgctgggacagaggtggtggaggcgaaagcgggtgctggatctgctaccctgtccatggcttatgctgctgccagatttgttgagtcttcactccgtgcactggctggtgatccagatgtttatgagtgcacgtatgttcagtctgagttaactgagctgccattctttgcgtccagagttaagattggcaagaatggtgttgagtccatcatttctttggacctggagggaataactgagtacgaggccaatgcactcgaggcattgaagcctgagctgaaggccagcatcgagaagggcatcgagtttgcgcacaaacagcagggagccgccgcatctgtttgaagtgaggagaacggcgattccatacgaagagaaggcaaaatgattctccttgtcttctagttttgcagcctagagtattgacatgtagcagtatgccttggagcatctatatatttctcaattgttggtcagtttattacgattccagtttacatgagggcgtgaagccccaaacttgcaccctgttctggggccttgttttgtttgacacataaattttggtcctgttccacctgctgttcttgtagcttctggagttcaactgtggactaataaagaacatctttgatcattaccaaggcacgccatctagatctgcctctacttgtggtaacatattgtatggtgtcataagttatcaattgctgttgtaagatgagccagtgggatgaataataccttgtgcaagattttcgtacaaaaaaaaaaaaaaa

SEQ ID NO: 163 - protein, 394 aa, Triticum aestivum
MASSATISSVGAQAALVSKPRNHGIGGLKASSSINFELGSSFLGKTGSLRASVTTRVVPKAKSGARILPEASYKVAVLGAAGGIGQPLGLLIKMSPLVSELRLYDIANVKGVAADLSHCNTPSQVMDFTGPAELASCLKGVDVVVIPAGVPRKPGMTRDDLFNINAGIVKSLIEAVADNCPDAFIHIISNPVNSTVPIAAEILKQKGVYNPKKLFGVSTLDVVRANTFVAQKKGLKLIDVDVPVVGGHAGITILPLLSKTRPSVTFTDEETEQLTKRIQNAGTEVVEAKAGAGSATLSMAYAAARFVESSLRALAGDPDVYECTYVQSELTELPFFASRVKIGKNGVESIISLDLEGITEYEANALEALKPELKASIEKGIEFAHKQQGAAASV

SEQ ID NO: 164 - DNA, 1448 bp, Zea mays
  CDS (204)..(1388)
tttcgtatagcaccgaaggcgaggagggggggccaaggacgagcgccttttcgtgcccgctggccattgccgctgctcacgagcctcccgcctcttgctgccctgccctctgcggctctgccccaacgagccccaggagagccagccagccagttaaaggagccgtcaaaagcccccgccgaggagagcacgcaaggtcagacatggcgtcaaccgttaccttcagcccagttagcacccaagctgggttgatccataagccaaggaaccttggagccacaagctacgctggcttaaaggtgccgagctttggctctgagtcatcattcttgggtaggaacgcatcccttcgggcggctgttactacaaggattgtgcccaaggcaaagtctggatctcagatatcgccacaggcatcttacaaggtggcgctgctcggtgctgctggtggcatcggtcaacccttgggcctattgattaagatgtctcccctggtgtccgagctgcatctgtatgatattgctaatgtcaagggagtcgctgcagatctcagccactgcaacacgcccgctcaggtacttgacttcactgggccctcagagttagccagctgcttgaaaggcgtggatgttgttgtcatccctgccggggtcccaaggaagccgggcatgactcgtgatgacctttttaacatcaacgcgagcatcgtcaagtcacttgttgaggctgtcgcggacaattgccccgaggcgttcatccatatcatcagcaacccggtgaattccaccgtgccaatcgcagcagaggttttgaagcagaagggcgtctacaatcccaagaagctttttggggttaccaccctggatgttgtcagggctaacacatttgtggcgcagaagaagaaccttaatctcatcgatgttgatgtcccagttgttggtggccatgctgggatcacaattctgccgttgctatcaaagaccaggccgtccgtcaccttcacagatgaggaagctgaggagctgacaaagaggatacagaatgccgggacagaggtggtggaggcaaaggctggtgctgggtctgctaccctgtccatggcctacgctgctgccagattcgtcgagtcgtctctccgcgccctggccggcgaccccgatgtttacgagtgcacatttattcagtccgaggcaaccgatctgccattcttcgcatcaagagtcaagctcggcaagagtggtgtcgaatccatcgtttctgccgacctcgagggagtgaccgagtgcgaggccaaggcgcttgacgcgcttaaggccgagttgaagggaagcattgagaagggtgtcgccttcgccagcaaacagcaggaggctgctgcatctgtttgaagtgtccacaagagaataaagggacaatggtcttgaatggctttttaaaaaaaaaaaaaa

SEQ ID NO: 165 - protein, 394 aa, Zea mays
MASTVTFSPVSTQAGLIHKPRNLGATSYAGLKVPSFGSESSFLGRNASLRAAVTTRIVPKAKSGSQISPQASYKVALLGAAGGIGQPLGLLIKMSPLVSELHLYDIANVKGVAADLSHCNTPAQVLDFTGPSELASCLKGVDVVVIPAGVPRKPGMTRDDLFNINASIVKSLVEAVADNCPEAFIHIISNPVNSTVPIAAEVLKQKGVYNPKKLFGVTTLDVVRANTFVAQKKNLNLIDVDVPVVGGHAGITILPLLSKTRPSVTFTDEEAEELTKRIQNAGTEVVEAKAGAGSATLSMAYAAARFVESSLRALAGDPDVYECTFIQSEATDLPFFASRVKLGKSGVESIVSADLEGVTECEAKALDALKAELKGSIEKGVAFASKQQEAAASV

SEQ ID NO: 166 - DNA, 1858 bp, Glycine max
  CDS (317)..(1546)
cagatctgtgtaaacgctattctcttccatttccatttctcaattgtctttctgtattccattatcgatgttgcaattttcattcaaaattacactctcattaactaattttagaacatgtatgcaagttgttttcagctctttctgtgttgtatgctatggcatcttaattggttcgattgaataatctgttaggtctaccctagcaaaacaaaccttatactttcttatttccttggtgctttttgtagctttcagataggtttctgtgtgttaatcgaatagacctgaattatttattgtatcacaggttgtgatggcagcagcaccagcagctaccttcgctattggaaccaccggttccctcggccaaagaggaagctcgcttcctcaatcaaagtcctttgggttgaaattcaactctctgaatcatttgaagagcttctgtggcctcaaggccatgtcatccgtgagatgtgagtcggaatcctccttcttcggtaacaaaaccggtgctgctctacgggcgtcttttgcatccaaagctcaaaaggaaaacaaccacaactcgcagcctcaggcttcgtacaaagttgcggttcttggtgctgctggagggataggtcagccgctctcgcttctcatcaagatgtcgcctttagtttccaacctgcatctctatgatattgcgaatgtcaagggagttgctgctgatatcagtcactgcaacacaccctcacaggtcagggatttcactggagcttctgagttgccgaattgtttgaaggatgtgaatgttgttgtcatacccgccggtgttccaaggaagcctggcatgactcgtgacgaccttttcaacatcaatgctggcattgtcagggacttggtttctgctgttgcggattactgccctgatgcttttgttcaaattatcagtaaccctgtgaactctaccgtgcctattgccgcagaagttttgaaacagaagggtgtgtatgatcctaagaagctctttggggttaccacactggatgttgtgcgggcaaacacgtttgttgctcagaggaagaacctgaagctgattgacgttgatgtcccagttgttggtggccatgccgggattaccattcttcctctgttgtcaaagacaagaccctcggcgagtttcactgatgaagaaattgatgagttgactgtcaggattcaaagcgctggaactgaagttgttgtagcaaaggcaggcacagggtctgctaccttgtcgatggcatatgctgctgctagatttgttgaatcgtctcttcgcgcacttgatggagatggggatgtgtatgagtgctcatttgtggaatcaaacttgactgaccttccattctttgcttcaagggtgaaacttggtaggacaggagttgaggctttaattccatctgacctccaagggttgactggctatgagcagaaggctttggaagcacttaagcctgaactcaaggccagcatagagaaggggattgcttttgctcagaagcaaactgttgctgcttaaatttccttgtcagcaggtggtttcttgggttatggatttatttgagcataaatactacttagaggacttaggttgcagatttgttgtagcatctttactgcttccagaacttaggattcagactttctatgtatcaattctacttccagttttgttagtagaacgggaggacgcttccatttctgttctctaaaccgagcttaggttttggtcagaaatcttcaaagatgtaagcattataatgtagaattgaaaaaaaatgtaaacgttgctttttgaataatatggccattagaccaaaaaaaaaaaaaa

SEQ ID NO: 167 - protein, 409 aa, Glycine max
MAAAPAATFAIGTTGSLGQRGSSLPQSKSFGLKFNSLNHLKSFCGLKAMSSVRCESESSFFGNKTGAALRASFASKAQKENNHNSQPQASYKVAVLGAAGGIGQPLSLLIKMSPLVSNLHLYDIANVKGVAADISHCNTPSQVRDFTGASELPNCLKDVNVVVIPAGVPRKPGMTRDDLFNINAGIVRDLVSAVADYCPDAFVQIISNPVNSTVPIAAEVLKQKGVYDPKKLFGVTTLDVVRANTFVAQRKNLKLIDVDVPVVGGHAGITILPLLSKTRPSASFTDEEIDELTVRIQSAGTEVVVAKAGTGSATLSMAYAAARFVESSLRALDGDGDVYECSFVESNLTDLPFFASRVKLGRTGVEALIPSDLQGLTGYEQKALEALKPELKASIEKGIAFAQKQTVAA

SEQ ID NO: 168 - DNA, 1731 bp, Glycine max
  CDS (35)..(1372)
gtaaattcttttttctctttatctcccggtgaggatgcgtatattttacggctgcgagaagacgacagaaggggggagatttcaaacacaacttcgcttgttattcttccaattccattcattcgttcattcccaggttgtgatggcagcagcaccagcagctaccttcgctattggaaccaccggttccctcggccaaagaggaagctcgcttcctcaatcaaagtcctttgggttgaaattcaactctctgaatcatttgaagagcttctgtggcctcaaggccatgtcatccgtgagatgtgagtcggaatcctccttcttcggtaacaaaaccggtgctgctctacgggcgtcttttgcatccaaagctcaaaaggaaaacaaccacaactcgcagcctcaggcttcgtacaaagttgcggttcttggtgctgctggagggataggtcagccgctctcgcttctcatcaagatgtcgcctttagtttccaacctgcatctctatgatattgcgaatgtcaagggagttgctgctgatatcagtcactgcaacacaccctcacaggtcagggatttcactggagcttctgagttgccgaattgtttgaaggatgtgaatgttgttgtcatacccgccggtgttccaaggaagcctggcatgactcgtgacgaccttttcaacatcaatgctggcattgtcagggacttggtttctgctgttgcggattactgccctgatgcttttgttcaaattatcagtaaccctgtgaactctaccgtgcctattgccgcagaagttttgaaacagaagggtgtgtatgatcctaagaagctctttggggttaccacactggatgttgtgcgggcaaacacgtttgttgctcagaggaagaacctgaagctgattgacgttgatgtcccagttgttggtggccatgccgggattaccattcttcctctgttgtcaaagacaagaccctcggcgagtttcactgatgaagaaattgatgagttgactgtcaggattcaaaacgctggaactgaagttgttgaagcaaaggcaggcacagggtctgctaccttgtcgatggcatatgctgctgctagatttgttgaatcgtctcttcgcgcacttgatggagatggggatgtgtatgagtgctcatttgtggaatcaaacttgactgaccttccattctttgcttcaagggtgaaacttggtaggacaggagttgaggctttaattccatctgacctccaagggttgactgactatgagcagaaggctttggaagcacttaagcctgaactcaaggccagcatagagaaggggattgcttttgctcagaagcaaactgttgctgcttaaatttccttgtcagcaggtggtttcttgggttatggatttatttgagcataaatactacttagaggacttaggttgcagatttgttgtagcatctttactgcttccagaacttaggattcagactttctatgtatcaattctacttccagttttgttagtagaacgggaggacgcttccatttctgttctctaaaccgagcttaggttttggtcagaaatcttcaaagatgtaagcattataatgtagaattgaaaaaaaatgtaaacgttgctttttgaataatatggccattagaccagtttttggttttttgctggataaaaaaaaaaaaaaaaaaaaaaaaaaaaaaaaaaagaat

SEQ ID NO: 169 - protein, 445 aa, Glycine max
MRIFYGCEKTTEGGRFQTQLRLLFFQFHSFVHSQVVMAAAPAATFAIGTTGSLGQRGSSLPQSKSFGLKFNSLNHLKSFCGLKAMSSVRCESESSFFGNKTGAALRASFASKAQKENNHNSQPQASYKVAVLGAAGGIGQPLSLLIKMSPLVSNLHLYDIANVKGVAADISHCNTPSQVRDFTGASELPNCLKDVNVVVIPAGVPRKPGMTRDDLFNINAGIVRDLVSAVADYCPDAFVQIISNPVNSTVPIAAEVLKQKGVYDPKKLFGVTTLDVVRANTFVAQRKNLKLIDVDVPVVGGHAGITILPLLSKTRPSASFTDEEIDELTVRIQNAGTEVVEAKAGTGSATLSMAYAAARFVESSLRALDGDGDVYECSFVESNLTDLPFFASRVKLGRTGVEALIPSDLQGLTDYEQKALEALKPELKASIEKGIAFAQKQTVAA

SEQ ID NO: 170 - DNA, 1453 bp, Zea mays
  CDS (122)..(1144)
gatcggccgcccaatccttggctcggggggcataccgcaccgagctcactccccctttcgccttcgtcccagatctcaagcccgccgcagagaacgacaggacccaaaccccaattccacaatgaggccgtcgctgatgagatccacctcccagctcctccgccgccggagctactcctccgcatccgggcagcccgagcggaaggtggccatcctcggggcggcggggggcatcgggcagccgctgtcgctgctcatgaagctcaacccactcgtctcctccctctcgctctacgatatcgccggcaccccaggtgtcgcggccgacgtctcccacatcaactcccccgccctggtgaagggtttcatgggtgatgagcagcttggggaagcgctagagggctcggacgtggtgatcataccggccggcgtcccgaggaagcccggcatgaccagggacgacctattcaatatcaacgctggcatcgttaagaacctcagcaccgccatcgccaagtactgccccaatgcccttgtcaacatgatcagcaaccctgtgaattcaactgtaccgattgctgctgaggttttcaagaaggctgggacatatgatgagaagaagttgtttggcgtgaccacccttgatgttgttcgtgctaagactttctatgctgggaaggctaatttaccagttaccgatgtgaatgtccctgttgttggtggtcatgcgggtatcactatcctgccgttgttctcacaggccacccctgcaaccaacgcattgtctgatgaagacatcaaggctctcaccaagaggacacaggatggtggaactgaagttgtcgaggcaaaggctgggaagggctctgcaaccttgtccatggcgtatgctggtgctgtttttgcagatgcatgcttgaagggtctcaatggagttccggatattgttgagtgctcttttgttcaatcaactgtaacagagcttccattctttgcatctaaggtaaggcttgggaagaatggagttgaggaagtgcttggattaggtgagctgtcggactttgagaaagaagggttggagaagctcaagagcgagctcaagtcttcgattgagaagggtatcaagtttgcaaatgataactagataaggccattttgcagattatagcagcaattgaaacctttagtagcaattgaaacctttagttgcgggatcttctgatttcattctacccttttctgtccctttttgtgagggagtggaaggtattacaataaaaaacctgatgggcaaagcttacaagagggatttattccagcaggcaggcacataacttatgtcaagttttgtactgaaccagtcgtatatgagctttctgctgccttttataatcgacggtgctgtcttgtgtgtgtagggcaagctgcgaccggggggccgtgttcccaactc

SEQ ID NO: 171 - protein, 340 aa, Zea mays
MRPSLMRSTSQLLRRRSYSSASGQPERKVAILGAAGGIGQPLSLLMKLNPLVSSLSLYDIAGTPGVAADVSHINSPALVKGFMGDEQLGEALEGSDVVIIPAGVPRKPGMTRDDLFNINAGIVKNLSTAIAKYCPNALVNMISNPVNSTVPIAAEVFKKAGTYDEKKLFGVTTLDVVRAKTFYAGKANLPVTDVNVPVVGGHAGITILPLFSQATPATNALSDEDIKALTKRTQDGGTEVVEAKAGKGSATLSMAYAGAVFADACLKGLNGVPDIVECSFVQSTVTELPFFASKVRLGKNGVEEVLGLGELSDFEKEGLEKLKSELKSSIEKGIKFANDN

SEQ ID NO: 172 - DNA, 1918 bp, Zea mays
  CDS (359)..(1543)
  misc_feature (1912)..(1912): n is a, g, c or t
atataccgggtccacgcgcgcaagggcgggcgggaatccccctccgttgtttcctaggccgcaccgcagtcgccctcgccgcctccgtctccgtcggttcgtcgggcgcaatagaaaaaccaccgaacgcgccgccgctcctgccctgccccccgtatctataccaccgaaggcgaggaagggggggccaaggacgagcgctttttcgtgcccgctggccattgccgctgctcacgagcctcccgccccgcgctgccctgccctctgcggctctgccccaacgagccccaggagagccagccagccagttaaaggagccgtcaaaagcccccgccgaggagagcacgcaaggtcagacatggcgtcaaccgttaccttcagcccagttagcacccaagctgggttgatccataagccaaggaaccttggagccacaagctacgctggcttaaaggtgccgagctttggctctgagtcatcattcttgggtaggaacgcatcccttcgggcggctgttactacaaggattgtgcccaaggcaaagtctggatctcagatatctccacaggcatcttacaaggtggcgctgctcggtgctgctggtggcatcggtcaacccttgggcctattgattaagatgtctcccctggtgtccgagctgcatctgtatgatattgctaatgtcaagggagtcgctgcagatctcagccactgcaacacgcccgctcaggtacttgacttcactgggccctcagagttagccagctgcttgaaaggcgtggatgtcgttgtcatccctgccggggtcccaaggaagccgggcatgactcgcgatgacctttttaacatcaacgcgagcatcgtcaagtcacttgttgaggctgttgcggacagttgccccgaggcgttcatccatatcatcagcaacccggtgaattccacggtgccaattgcagctgaggttctgaagcagaagggtgtctacaatcccaagaagcttttcggggttaccaccctggatgttgtcagggccaacacatttgtggcgcagaagaagaaccttaagctcatcgatgttgatgtcccagttgttggtggccatgctggaatcacaattctgccattgttatcgaagaccaggccatctgtcaccttcacagatgaggaaactgaggagctgacaaagaggatacagaatgccgggacagaggtggtggaggcaaaggctggtgctgggtctgctaccctgtccatggcctacgctgctgccagattcgtcgagtcgtctctccgtgccctggccggcgacccggatgtttatgagtgcacatttattcagtccgaggcaaccgatctgccattcttcgcatcaagagtcaagctcggcaagaatggtgtcgagtccatcgtttctgccgacctcgagggagtgaccgagtgcgaggccaaggcgcttgacgcgcttaaggccgagttgaagggaagcattgagaagggtgtcgccttcgccagcaaacagcaggaggctgctgcatctgtttgaagtgaagcaagtgaaatgtatgtccacaagagaataaagggacaatggtcttgaatggcttttaagttttgcagcctagagtttttttgttttggtgtcaacgtgtaggaggaagacgcagagatggttgctgttgctgttagtttctaattactacatggggactggacatccatccccccccaagttatcgcatgtttctaaaccaggccctgcttaacaccacatatctattttttttctactcttgtattgtggttctgtttgtagcttgttcgagtttacgaactacaaagaagctaataaaaacacttgtattgaaaaaaaaaaaaaaaaaggcccctaaaaaaaaaaaaaaaaaaagaaaangaggaa

SEQ ID NO: 173 - protein, 394 aa, Zea mays
MASTVTFSPVSTQAGLIHKPRNLGATSYAGLKVPSFGSESSFLGRNASLRAAVTTRIVPKAKSGSQISPQASYKVALLGAAGGIGQPLGLLIKMSPLVSELHLYDIANVKGVAADLSHCNTPAQVLDFTGPSELASCLKGVDVVVIPAGVPRKPGMTRDDLFNINASIVKSLVEAVADSCPEAFIHIISNPVNSTVPIAAEVLKQKGVYNPKKLFGVTTLDVVRANTFVAQKKNLKLIDVDVPVVGGHAGITILPLLSKTRPSVTFTDEETEELTKRIQNAGTEVVEAKAGAGSATLSMAYAAARFVESSLRALAGDPDVYECTFIQSEATDLPFFASRVKLGKNGVESIVSADLEGVTECEAKALDALKAELKGSIEKGVAFASKQQEAAASV

SEQ ID NO: 174 - DNA, 1706 bp, Zea mays
  CDS (227)..(1249)
ttgggtacctcgaggccggccggggcagaaaaaatagaatcgttctcattcttcttcctcaagtatcgtagttctctactgatgtcttcgtcttagtttcatactggtgtcttcactcagcaacttccctcagatcccatccacccctcgctattaaagcagcccaggccgccgcccgccgccgctcacccaccaatccacagcgagacccgaccccgccgtcgcgatgaggccggcgctgctcaagtccacggccgagctcctccgccgcagccgcggctacgcctcctcggccaacccggagcggaaggtggccatcctgggcgctgcgggcggcatcgggcagccgctctccctcctcatgaagctcaacccgctcgtctcctccctctccctctatgatatcgccgggacccccggcgtcgcggccgacgtctcccacatcaactcccccgccctggtgaaggggttcatgggggacgaccagctcggggaggcgctcgagggctccgacgtcgtcatcatcccagccggggtgcccaggaagcccggcatgactagggacgacctcttcaacatcaacgccggcatcgttaaggggctctgcactgccatcgccaagcactgccccaacgctcttgtcaatatgatcagcaaccctgtcaactccactgtcccgattgcggcggaggttttcaagaaggctggtacttatgatgagaagaagctgtttggtgtgactactcttgatgttgttcgtgctaaaactttttatgctggaaaagcgggtgtgccagttactgaggtgaatgttcctgttgttggaggccatgcgggtattactattctgccactcttctcgcaggccactcctgcaagcaattcgttgtcccaagaagacattgaggccctcaccaagaggacacaagatggtgggacagaggtggttgaagcaaaggcgggaaaaggctctgcaacgttgtccatggcatatgctggtgctgtttttgcagatgcatgtttgaagggtctgaatggagttccagacattgtagagtgctcttttgtgcaatcaactgtgacagagttgccattctttgcctctaaggttcggctcggcaagaatggagtggaggaagtgcttggtctgggtgagctcaacgagttcgagaagaaggggctggaaaacctcaagggcgagctcaagtcttccatcgacaagggtatcaagtttgcccacgggaactaggcaccttgcgtccttgcccggcttctaacaattgatgcccccccttgcatttttgtttgactgcctatttttcctgccccccgtatggttggggcaatgaggcgtagtggtcgataataaaacccagcggaacaaagaaaacgtgtaccagaaactgtttgcaaacaccggtgcctttttttgtgttgaaccaccattagttgagccgtgagggaatggtgaacaagctttccacttgctcatttccgagcgcttctctttgattgtatgcatggtttggactcatgactggacgtcttggcagttggcttggcacccaggaatctaatcactggagttgctgctgttatcgagattttgcagcgttgcattctgatcggaactgttgagctggacaatttgatggttctacatgcattgtatggatgcttgttcgtatgcacacattgatgccact

SEQ ID NO: 175 - protein, 340 aa, Zea mays
MRPALLKSTAELLRRSRGYASSANPERKVAILGAAGGIGQPLSLLMKLNPLVSSLSLYDIAGTPGVAADVSHINSPALVKGFMGDDQLGEALEGSDVVIIPAGVPRKPGMTRDDLFNINAGIVKGLCTAIAKHCPNALVNMISNPVNSTVPIAAEVFKKAGTYDEKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNEFEKKGLENLKGELKSSIDKGIKFAHGN

SEQ ID NO: 176 - DNA, 1651 bp, Zea mays
  CDS (260)..(1282)
ccggccgggagcagagcacagttatcacctcgggcgaacgggcggagacgtcgaaacgagacgcccaaaacccctcgcctttctctctctcccaccgccgtccgccaccaacaacttctcttcagatcccaatcccatccaacctttggatcctttccttcagtgctcccctcacttctcgccgccgcccactgccgctccccccaccaatccacagcgagacacgcccgagcgagtgatccccgacccagccgccgccatgaggccgtcgctgctgaagtccacggccgagctcctccgccgcagccgcggctacgcgtcctcggccaatccggagcggaaggtggccatcctgggcgcggcgggtggcatcgggcagccgctctcgctcctcatgaagctcaacccgctcgtttcctccctctccctctacgatatcgccggcacccccggcgtcgcggccgacgtctcccacatcaactcccccgccctggtgaaggggttcatgggggacgaccagctcggggaggcgctggagggctccgacatcgtcatcatccccgcaggagtgcccaggaagcccggcatgaccagggacgacctcttcaacatcaacgccggcatcgttaaggcgctgtgcactgccatcgccaagcactgccccaacgctcttgtcaatatgatcagtaaccctgtcaactctactgtcccgattgctgcggaggttttcaagaaggctggtacttatgatgagaagaagctgtttggtgtgactactcttgatgttgttcgtgctaaaacgttttatgctggaaaggctggcgtgccagttactgaggtgaatgttcctgttgtcgggggccatgcgggtattactattctgccactcttctcacaggccactccagcaagcaattcgttgtcccaagaagacattgaggccctcaccaagaggacacaagatggtgggacagaggttgttgaagcaaaggctggaaagggctctgcaacattgtccatggcatatgctggtgctgtttttgcagatgcatgcttgaagggtctgaatggagttccggacattgtagagtgctcttttgtgcaatcaaccgtgacagagttgccgttctttgcctccaaggttcggctcggcaagaatggagtggaggaagtgcttggtctgggtgagctcaacgacttcgagaagaaggggctggaaagcctcaaggtcgagctcaagtcttccattgaaaagggtatcaagttcgcccacgggaactaggcaactcgcccggcttctaacagttgatatcccttgcattttttttgtttgactgcctttttccccccgccccgttatggttgacgcaatgaggctttgtggtccataataaaacacagcggagtgtagaaaatgtgcaccaggagcagtttacaaacagcggttcttttttgtgctgaaccaccagtagttgagccgtgaaggaatggaaaaactttccacttgctcatttccgagcgccttctcattcattgtatgcatgttttggactcgtggctggacgtcttgcacacaggaatccaatcactggagtagcaagatactggtatgaaaaatccagactgctgttctaaaaaaaaaaaaaaaaaa

SEQ ID NO: 177 - protein, 340 aa, Zea mays
MRPSLLKSTAELLRRSRGYASSANPERKVAILGAAGGIGQPLSLLMKLNPLVSSLSLYDIAGTPGVAADVSHINSPALVKGFMGDDQLGEALEGSDIVIIPAGVPRKPGMTRDDLFNINAGIVKALCTAIAKHCPNALVNMISNPVNSTVPIAAEVFKKAGTYDEKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNDFEKKGLESLKVELKSSIEKGIKFAHGN

SEQ ID NO: 178 - DNA, 1293 bp, Triticum aestivum
  CDS (113)..(1189)
tttttctcccgccctcgcaaccacctcccctcccctgtcctgccgagagtctcttctcttctcgtctctcgtcgcctcccgagtctccggcgaccacgccaactagacggccatggagcaaggcgccgactccgcggcggcgaggcggatggccagggtcgcctcccacctccgcccgcccacctcgcagatggaggaggtggccatcttgaagggctctgattgccgtgcaaaaggtgcggcaccagggttcaaggtcgcagtcctgggtgcatctggtggaattggccagccgctctcgctgctcatgaagatgaaccctcttgtttcggtgctccatttatatgatgttgtcaacacacctggtgtcacagctgacattagccacatgaacaccggtgctgtggtgcgtggcttcttgggtcagtcacaattggaaagtgctcttactggaatggatcttgtgatcattcctgctggcattcctcggaaacctgggatgacaagggatgatttgttcaacatcaatgccgggattgttcggactctttgtgagggaattgcaaaatgctgcccaaatgcgattgtgaatgtgatcagtaaccctgtaaattctaccgttccgatcgctgctgaagtatttaaaaaagctggaacatatgatcctaagcgcctattgggggtgacaacacttgatgtagtgagagccaatacctttgtgggagaggttcttggacttgaccccagagatgtcaatgttcctgttgttggtgggcatgcaggagttacgatattaccactcctttcacaggtgaatcctccctgctcgtttacctcagaagaaattagttatctcacttctcgcatacagaatggtgggacagaagtagttgaggccaaagcaggagcaggatccgcgactctttccatggcctacgcagcagccaaattcgcggacgcgtgcctgagagggctgcgcggcgacgccgggatagtggagtgctcttacatagcctgtcaggtgacggagctgcccttcttcgcgtccaaggtgcggctgggccggtcgggcgtcgaggaggtcctgccgctcggcccgctgaacgagtttgagagggcggggctggagaaggccaagggcgagctggccgagagcatccacaagggcgtcgcctttgccaacaagtgaagtgaagacaagagaagagaaatctttcgccccagcatagaaatctgagatgcctcttgcttcctgggagcaacggtcgccgtgtcattgtctcatctccctgt

SEQ ID NO: 179 - protein, 358 aa, Triticum aestivum
MEQGADSAAARRMARVASHLRPPTSQMEEVAILKGSDCRAKGAAPGFKVAVLGASGGIGQPLSLLMKMNPLVSVLHLYDVVNTPGVTADISHMNTGAVVRGFLGQSQLESALTGMDLVIIPAGIPRKPGMTRDDLFNINAGIVRTLCEGIAKCCPNAIVNVISNPVNSTVPIAAEVFKKAGTYDPKRLLGVTTLDVVRANTFVGEVLGLDPRDVNVPVVGGHAGVTILPLLSQVNPPCSFTSEEISYLTSRIQNGGTEVVEAKAGAGSATLSMAYAAAKFADACLRGLRGDAGIVECSYIACQVTELPFFASKVRLGRSGVEEVLPLGPLNEFERAGLEKAKGELAESIHKGVAFANK

SEQ ID NO: 180 - DNA, 1293 bp, Triticum aestivum; identical to SEQ ID NO: 178
  CDS (149)..(1189)

SEQ ID NO: 181 - protein, 346 aa, Triticum aestivum
MARVASHLRPPTSQMEEVAILKGSDCRAKGAAPGFKVAVLGASGGIGQPLSLLMKMNPLVSVLHLYDVVNTPGVTADISHMNTGAVVRGFLGQSQLESALTGMDLVIIPAGIPRKPGMTRDDLFNINAGIVRTLCEGIAKCCPNAIVNVISNPVNSTVPIAAEVFKKAGTYDPKRLLGVTTLDVVRANTFVGEVLGLDPRDVNVPVVGGHAGVTILPLLSQVNPPCSFTSEEISYLTSRIQNGGTEVVEAKAGAGSATLSMAYAAAKFADACLRGLRGDAGIVECSYIACQVTELPFFASKVRLGRSGVEEVLPLGPLNEFERAGLEKAKGELAESIHKGVAFANK

SEQ ID NO: 182 - DNA, 1293 bp, Triticum aestivum; identical to SEQ ID NO: 178
  CDS (191)..(1189)

SEQ ID NO: 183 - protein, 332 aa, Triticum aestivum
MEEVAILKGSDCRAKGAAPGFKVAVLGASGGIGQPLSLLMKMNPLVSVLHLYDVVNTPGVTADISHMNTGAVVRGFLGQSQLESALTGMDLVIIPAGIPRKPGMTRDDLFNINAGIVRTLCEGIAKCCPNAIVNVISNPVNSTVPIAAEVFKKAGTYDPKRLLGVTTLDVVRANTFVGEVLGLDPRDVNVPVVGGHAGVTILPLLSQVNPPCSFTSEEISYLTSRIQNGGTEVVEAKAGAGSATLSMAYAAAKFADACLRGLRGDAGIVECSYIACQVTELPFFASKVRLGRSGVEEVLPLGPLNEFERAGLEKAKGELAESIHKGVAFANK

SEQ ID NO: 184 - DNA, 1728 bp, Triticum aestivum
  CDS (246)..(1430)
attcttttcttcccactcccccctgcccttccgccaaagcgtcagccgccgccttgccatacctcgtcgtcaccgccggcgccgcgacctcaatcccgcgccctccgccaccttcttggggacgcgcgtcgacgccgccgccgccgccgttccccttcttccccggcctccgggacatcctgctgctgcctccacctcgtcccagtctttggccactgggcctccttccttcgttcgagttggacatggcatcatctgctaccatcagttcagttggcgctcaggccgctctggtttcaaagccaaggaatcatggtatcagtggcttaaaggcatcctcatcaattagcttcgaattgggatcctcattcctgggcaagaccgggtctcttcgggcatctgtaaccacaagggttgcgccaaaggcgaagtccgcggctcggatactaccggaggcatcttacaaagtggcggtacttggtgctgctgggggcatcggccaaccattgggcttgttgatcaagatgtcccctctggtctcagaactgcgcctgtacgatattgcgaatgtcaagggagtcgccgctgatctcagccactgcaacacaccctctcaggttatggacttcactggccctgcagaattggccagctgcttgaaaggtgtggatgttgttgtcatccccgccggggtcccaagaaagccagggatgactcgtgacgaccttttcaacatcaatgcgggcatcgtcaagtcacttatcgaggctgttgcagacaattgccctggggcctttatccatattatcagcaacccagtcaactccacagtgccgattgctgctgagattctgaaaaagaagggtgtctacaatcccaagaagctttttggggtttccaccctagatgttgtccgggctaacacatttgtagctcagaagaagggcctcaagctcattgatgttgatgtcccagttgttggtggtcatgctggaattacaatcctgcctttgttgtcaaagacgagaccatctgtcaccttcacggacgaggaaactgaacagctgacgaagaggatacagaacgctgggacagaggtggtggaggcgaaagcgggtgctggatctgctaccctgtccatggcttatgctgctgccagatttgtcgagtcttcgctccgcgcactggctggtgatccagatgtttacgagtgcacgtatgttcagtctgagttaactgagctgccattctttgcgtccagagttaagcttgggaagaatggtgttgagtccatcatttcttctgacctggagggaataaccgagtatgaggccagtgcacttgaggcattgaagcctgagctgaaggccagcattgagaagggcattgagtttgcgcacaaacaacagggagctgctgcctctgtttgagtgaggagaatgataattccatatgaagaggacaaaggcaaactgattgtccttttctagttttgcagcctagagtgtggacatgtagcactatgccctggagcagctatatttctgaattgttggtcagtttattatgattccagtttacatgagggcgtgaagccccaaacgtgcaccctgttctgggtccttgttttgtttgacacataaattttggtcctgttccacctgctgttcttgtagcttcctaagttgacgaactgtggaataataataaagcccatctttgatcgtt

SEQ ID NO: 185 - protein, 394 aa, Triticum aestivum
MASSATISSVGAQAALVSKPRNHGISGLKASSSISFELGSSFLGKTGSLRASVTTRVAPKAKSAARILPEASYKVAVLGAAGGIGQPLGLLIKMSPLVSELRLYDIANVKGVAADLSHCNTPSQVMDFTGPAELASCLKGVDVVVIPAGVPRKPGMTRDDLFNINAGIVKSLIEAVADNCPGAFIHIISNPVNSTVPIAAEILKKKGVYNPKKLFGVSTLDVVRANTFVAQKKGLKLIDVDVPVVGGHAGITILPLLSKTRPSVTFTDEETEQLTKRIQNAGTEVVEAKAGAGSATLSMAYAAARFVESSLRALAGDPDVYECTYVQSELTELPFFASRVKLGKNGVESIISSDLEGITEYEASALEALKPELKASIEKGIEFAHKQQGAAASV

SEQ ID NO: 186 - DNA, 1681 bp, Zea mays
  CDS (357)..(1403): subsp. mays
ctgcacttttctaccaccgaaggcgagggcgagggggccaaagacgagcgctttttcgtgcccgcctgcctgcctgctggtcattgccgctgctcacgagcctcccgccccgtgccgccctgccctctacggctctgccccaacgagccccaggggagccaggaaaaggagccgtcaaaagccgccgccgaggagagcgcgcaggtcaggcatggcatcaaccgttaccttcaacccagtgagcgcccaagctgcgctgatccaaaagccaaggaaccttggagccataagctatgctggcttaaagatgccggcatctgttagctctggctcagagtcgtcattcctgggctggaatgcatcccttcgggcagctgttactccaaggattgtgcccaaggcaaagtctggatctcagatatctccacaggcatcttacaaggtggcagtgctgggtgctgccggtggcatcggtcaacccttgggcctgttggttaagatgtctcctcttgtccgagctgcatctgtatgatattgctaatgtcaagggagttgctgcagatctcagccactgcaacacgcctgctcaggttcttgacttcactggaccctcagagttagccaactgcttgaaaggtgtggatgtcgttgtcatccctgccggggtcccaaggaagcctgggatgactcgcgatgacctttttaacatcaacgcaagcatcgtcaagacacttgttgaggctgttgcagacagttgcccagaggcgttcatccatatcatcagcaacccggtgaattccacggtgccaattgcagctgaggttctgaagcagaagggtgtctacaatcccaagaagctttttggggttaccaccttggatgttgtcagggccaacacatttgtggcgcagaagaagaaccttaagctcatcgatgttgatgtcccagttgttggtggccatgctggaatcacaattctgccactgttatcgaagacgaggccatctgtcaccttcacagatgaggaaactgaggagctgacaaagaggatacagaatgccgggacagaggtggtggatgccaaggctggtgctgggtctgctaccctgtccatggcctatgccgctgctagattcgttgagtcgtctctccgtgcgctggctggcgatccggatgtttatgagtgcacatttgttcagtctgagataactgacctgccattcttcgcatcaagagtcaagttgggcaagaacggtgttgagtctgtcatttctgccgacctccagggagtgactgagtatgaggccaaggcacttgaggcgctgaaggccgagttgaaggcaagcattgagaagggtattgctttcgtgaacaaacagcgggaagctgctgcatctgtttgaggcgaagcaagtgaaacggaaggaacaatcgtcttgaatggcttttaagttttgcagcctagagtttttttgttgtcggcatgtaggaagatgttccagatggttgctgtttgtttctaattgctacatgggggctgaacatccatcccccaagttatcgccggtttctgaaccaggccttatttacacataaattttgccccttctgtatcgtggtccagtttgtagcttgttggagtctacaaactacaaagaggctaataaaccacttttatttg

SEQ ID NO: 187 - protein, 348 aa, Zea mays subsp. mays
  subsp. mays
MHPFGQLLLQGLCPRQSLDLRYLHRHLTRWQCWVLPVASVNPWACWLRCLLLSELHLYDIANVKGVAADLSHCNTPAQVLDFTGPSELANCLKGVDVVVIPAGVPRKPGMTRDDLFNINASIVKTLVEAVADSCPEAFIHIISNPVNSTVPIAAEVLKQKGVYNPKKLFGVTTLDVVRANTFVAQKKNLKLIDVDVPVVGGHAGITILPLLSKTRPSVTFTDEETEELTKRIQNAGTEVVDAKAGAGSATLSMAYAAARFVESSLRALAGDPDVYECTFVQSEITDLPFFASRVKLGKNGVESVISADLQGVTEYEAKALEALKAELKASIEKGIAFVNKQREAAASV

SEQ ID NO: 188 - DNA, 1002 bp, Arabidopsis thaliana
  CDS (1)..(1002)
atggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtccgcgggttcttgggagcgaagcagcttgaggacgcgctaacgggtatggatcttgtgatcataccagccggtataccgaggaaaccagggatgacccgcgatgatctgtttaaaatcaatgctgggattgttaaaacactatgtgaaggtgtagcaaaatgttgtcctaatgctattgtcaacttgatcagcaaccctgtgaactctactgtccccattgccgctgaggttttcaagaaagctggaacttatgatcctaagaagctccttggagttactacactcgatgttgctcgtgccaacacatttgtggcagaagttcttggccttgatccaagagaagtcgatgtgccagtagttgggggacacgccggagtcacaatcttgccactactgtcacaggttaaacctcctagcagcttcacacctcaagaaattgagtacctgacaaaccggattcaaaatggtggaactgaagttgtggaggcaaaagctggagctggttctgcaacactttcaatggcatatgctgcagccaagtttgcagatgcttgccttcgcgggttaagaggagatgcgaatgtcgtagaatgctcttttgttgcttcacaggtgacagaattagctttctttgcaacaaaagtgcgccttggccgtacaggagcagaggaagtgtatcagcttggacccttaaacgaatacgaaaggattggtctggagaaagcaaaagatgaattagccggaagtattcagaaaggtgttgaattcatcagaaaatga

SEQ ID NO: 189 - protein, 333 aa, Arabidopsis thaliana
MEAKNSVIGRENCRAKGGNPGFKVAILGAAGGIGQSLSLLMKMNPLVSLLHLYDVVNAPGVTADVSHMDTGAVVRGFLGAKQLEDALTGMDLVIIPAGIPRKPGMTRDDLFKINAGIVKTLCEGVAKCCPNAIVNLISNPVNSTVPIAAEVFKKAGTYDPKKLLGVTTLDVARANTFVAEVLGLDPREVDVPVVGGHAGVTILPLLSQVKPPSSFTPQEIEYLTNRIQNGGTEVVEAKAGAGSATLSMAYAAAKFADACLRGLRGDANVVECSFVASQVTELAFFATKVRLGRTGAEEVYQLGPLNEYERIGLEKAKDELAGSIQKGVEFIRK

SEQ ID NO: 190 - DNA, 1215 bp, Oryza sativa
  CDS (1)..(1215): Japonica cultivar group
atggaactgttcctgcagttaggcatggcatcaactgttgccatcaatttgattggtgctcaggctggcattatctcaaagttaaggaattgcgacatcacaagctacagtggcttaaaggcaagatcatctattagttttgagtcaaggtcatcattcctgggtcagaatgcatctcttcgatcatctatctctccaaggattgtaccaaaggcaaactctggatctcacatttctcctgaggcatcttacaaagtggcagttctcggtgctgctggtggcattggtcaaccgttgggcttgttaattaagatgtctcctctggtctctgcactacatctgtatgatattgcaaatgtcaaaggagttgctgctgatctgagccactgcaacacaccttctcaggttctggactttactgggccctcggaattagccaactgcttgaaaggtgtggatgttgttgtcatccctgctggagtcccaaggaagccaggaatgactcgtgatgatctttttaacatcaatgcgagcattgtcaagacacttgttgaggctgttgcagacaattgtccagaagcctttatccatatcattagcaacccagtaaactcaacagtgcccattgctgctgaggttctgaaacagaagggtgtctataaccccaagaagcttttcggagttaccaccctagatgttgtcagagctaacacatttatagctcagaagaagaacctgaagctcattgatgttgatgtcccagttgttggtggtcatgctgggattactatcctaccattgctgtcaaaaaccagaccatctgtcaccttcacaaatgaggaaactgaagagctgacaaggaggatacagaatgctgggacagaggtggtggaggcgaaagctggtgctggatctgctaccctgtcgatggcctatgcagctgccagatttgttgagtcatccctccgtgcattggctggtgatccagatgtttacgagtgcacatttgttcaatctgaattaactgagctgctgttctttgcatctagggttaagcttggtaagaatggtgttgagtccatcatttcttccgaccttgagggagtgactgaatatgaggccaaggcccttgagtcattgaagcctgagttgaaggccagcattgagaagggcatcgagttcgtccacaaacagcaggctgccgctacttcttga

SEQ ID NO: 191 - protein, 404 aa, Oryza sativa
  Japonica cultivar group
MELFLQLGMASTVAINLIGAQAGIISKLRNCDITSYSGLKARSSISFESRSSFLGQNASLRSSISPRIVPKANSGSHISPEASYKVAVLGAAGGIGQPLGLLIKMSPLVSALHLYDIANVKGVAADLSHCNTPSQVLDFTGPSELANCLKGVDVVVIPAGVPRKPGMTRDDLFNINASIVKTLVEAVADNCPEAFIHIISNPVNSTVPIAAEVLKQKGVYNPKKLFGVTTLDVVRANTFIAQKKNLKLIDVDVPVVGGHAGITILPLLSKTRPSVTFTNEETEELTRRIQNAGTEVVEAKAGAGSATLSMAYAAARFVESSLRALAGDPDVYECTFVQSELTELLFFASRVKLGKNGVESIISSDLEGVTEYEAKALESLKPELKASIEKGIEFVHKQQAAATS

SEQ ID NO: 192 - DNA, 1023 bp, Oryza sativa
  CDS (1)..(1023): Japonica cultivar group
atgaggccgtcgctgatgagatccgcctcgcaggtcctccgccgccgccgcggctactcctccgcctccggccagccggagcggaaggtcgccatcctcggcgcggccggcggcatcgggcagccgctctccctcctcatgaagctgaacccgctcgtctcctccctctccctctacgatatcgccggcacccccggcgtcgccgccgacgtctcccacatcaacgccccggcccaggtgaaggggttcatgggggatgaccagctcggggaggcgttggaggggtcggacatcgtgatcatcccggccggcgtgccgaggaagcccggcatgaccagggacgacctcttcaacatcaacgccggcatcgttaagaacctctgcaccgccattgccaagtactgcccgaatgctcttgtcaacatgatcagcaacccagtgaattcaacggtcccaattgctgccgaggttttcaagaaggctgggacttacgatgagaagaagttgtttggtgtgactactcttgatgttgttcgtgctaagactttctatgctggaaaggccaatgtaccagttactgatgtgaatgtcccagttgttggtggtcatgcgggtatcaccatcctgccactgttctcacaggcaactcctgcaactaatgcgttgtctgatgaagacatcaaggctcttaccaagagaacacaggatggtgggactgaagttgttgaagcaaaggctggaaagggctctgcaaccttgtccatggcgtatgctggtgctgttttcgcaaatgcttgcttaaagggtctgaatggagtgccggacgttgttgaatgctcttttgtgcaatcaactgtaacagagctgccattctttgcctccaaggtgaagcttgggaagaatggagttgaggaagttcttgggttgggccagctgtcagactttgagaaggaaggactggagaatcttaagggcgagctcaaggcttcaattgagaagggtatcaaatttgcaaatgcgtag

SEQ ID NO: 193 - protein, 340 aa, Oryza sativa
  Japonica cultivar group
MRPSLMRSASQVLRRRRGYSSASGQPERKVAILGAAGGIGQPLSLLMKLNPLVSSLSLYDIAGTPGVAADVSHINAPAQVKGFMGDDQLGEALEGSDIVIIPAGVPRKPGMTRDDLFNINAGIVKNLCTAIAKYCPNALVNMISNPVNSTVPIAAEVFKKAGTYDEKKLFGVTTLDVVRAKTFYAGKANVPVTDVNVPVVGGHAGITILPLFSQATPATNALSDEDIKALTKRTQDGGTEVVEAKAGKGSATLSMAYAGAVFANACLKGLNGVPDVVECSFVQSTVTELPFFASKVKLGKNGVEEVLGLGQLSDFEKEGLENLKGELKASIEKGIKFANA

SEQ ID NO: 194 - DNA, 1194 bp, Oryza sativa
  CDS (1)..(1194): Japonica cultivar group
atggcatcagctgttaccatcagttcggttggcgctcaggctggcatgatctcaaagccaaggaatcatggcttcacaagctacagtggcctgaaggcagcatcatccgttagctttgaatcagggtcgtcattcctgggtaggaatgcatctctccgggcatctgttgctccaaggattgtaccaaaggcgaagtctggttctcaaatttctcctgaggcttcgtacaaagtggcagtgctcggtgctgctggtggtattggccaaccattgggccttttgattaagatgtctcctctggtctcagagctgcatctgtatgatattgcaaatgttaagggagttgctgctgatctcagccactgcaacacaccttctcaagttctggacttcactgggccctcggaactagccaactgcttgaaaggtgtggacgttgttgtcatccctgctggggtcccaaggaagccaggcatgactcgcgatgacctttttaacatcaatgcgagcattgtcaagtcgcttgttgaggctgttgcagacaattgtccagaggccttcatccatattatcagcaacccagtaaactccacggtgccaattgctgccgaggttctgaaacaaaagggtgtgtacaatcccaagaagctctttggagttaccaccctagatgttgttagagctaacacatttgtagctcagaagaagaacctcaagctcatcgatgttgatgttccagttgtcggtggtcatgctgggatcacaattctaccactgctgtcaaagaccatgccatctgtcaccttcacagatgaagaaactgaacagctgacaaagaggatacagaatgctggaacagaggtggtggaggcgaaagctggtgctggctccgctaccctctccatggcctacgctgctgccagattcgtcgagtcatctctgcgtgcacttgctggcgaccctgatgtttatgagtgcacattcgttcagtctgagttaaccgagctgccgttctttgcatccagagttaagcttggaaagaacggtgtcgagtccatcatttctgctgaccttgagggagtgaccgagtacgaggccaaggcacttgaggcattgaagtctgagttgaaggccagtatcgagaagggcatcgagttcgtccacaaacagcagacagcagcggcatctgtttga

SEQ ID NO: 195 - protein, 397 aa, Oryza sativa
  Japonica cultivar group
MASAVTISSVGAQAGMISKPRNHGFTSYSGLKAASSVSFESGSSFLGRNASLRASVAPRIVPKAKSGSQISPEASYKVAVLGAAGGIGQPLGLLIKMSPLVSELHLYDIANVKGVAADLSHCNTPSQVLDFTGPSELANCLKGVDVVVIPAGVPRKPGMTRDDLFNINASIVKSLVEAVADNCPEAFIHIISNPVNSTVPIAAEVLKQKGVYNPKKLFGVTTLDVVRANTFVAQKKNLKLIDVDVPVVGGHAGITILPLLSKTMPSVTFTDEETEQLTKRIQNAGTEVVEAKAGAGSATLSMAYAAARFVESSLRALAGDPDVYECTFVQSELTELPFFASRVKLGKNGVESIISADLEGVTEYEAKALEALKSELKASIEKGIEFVHKQQTAAASV

SEQ ID NO: 196 - DNA, 1215 bp, Oryza sativa
  CDS (1)..(1215): Japonica cultivar group
atggcatcagcagcaatgtctactctgaacctgagttcatctcctctgaccaagcagcagctccgatttggagccagcacactcagtgcagaacacgtcagtggcttcagctctgcaaggccagctccatcgttgtgctgctccagctctcactggcgagcggtcaagctgagaccgagacggcggccatggcggcgcgccgggaaccgggtcgtcgcgcaggccggcggctacaaggtcgccatcctcggcgccgccggtgggatcgggcagccgctctcgctcctcgtcaagatgtcgccgctcgtctcggcgctgcacctgtacgacattgcgaacgtcgatggtgtcaccgccgatcttggacactgcaacacgccggcgaaggtcgccgggttcaccggaaaggaggagctcgccggttgtcttgccggcgtggacgtcgtcgtcatccccgccggcgtgccgaggaagccagggatgacgcgggatgacctgttcggcatcaacgccggcatcgtgagggagctcgtcgaggccgtggcggaccacgcgccggcggcgctggtgcacgtcatctccaacccggtgaactccaccgtgccgatcgccgccgaggtgctgaagcggaagggcgtgtacgacccgcggaagctgttcggcgtcacgacgctggacgtcgtgcgcgccaacacgttcgtcgcggagatgaagggcctcccgctcgccgacgtcgacgtcccggtggtcggcggccacgcggcggccaccatcctcccgctgctgtccaaggcgaggcccaagacggcgttcaccgatgaggaggtggaggcgctgacgaggcggatccagaacgccgggaccgaggtggtggaggccaaggcgaaggccggcggcgggtccgcgacgctgtcgatggcgtacgcggcggcgaggttcctggaggcgtcgctgcgcgggctcgacggcgacgccgacgtgtacgagtgctcgtacgtgcagtgccaggcggtgccggagctgccgttcttcgcgtgccgggtgaagctgggcagggacggcgtcgaggaggtggcggcggcgggggcggagctccgggggctcacggagttcgaggcgcgcgcgctggaggcgctcaagccgcagctcaagaagagcatcgacaagggcgtcgcctacgcgcagcagcagccagcgacggtggcgatgggttga

SEQ ID NO: 197 - protein, 404 aa, Oryza sativa
  Japonica cultivar group
MASAAMSTLNLSSSPLTKQQLRFGASTLSAEHVSGFSSARPAPSLCCSSSHWRAVKLRPRRRPWRRAGNRVVAQAGGYKVAILGAAGGIGQPLSLLVKMSPLVSALHLYDIANVDGVTADLGHCNTPAKVAGFTGKEELAGCLAGVDVVVIPAGVPRKPGMTRDDLFGINAGIVRELVEAVADHAPAALVHVISNPVNSTVPIAAEVLKRKGVYDPRKLFGVTTLDVVRANTFVAEMKGLPLADVDVPVVGGHAAATILPLLSKARPKTAFTDEEVEALTRRIQNAGTEVVEAKAKAGGGSATLSMAYAAARFLEASLRGLDGDADVYECSYVQCQAVPELPFFACRVKLGRDGVEEVAAAGAELRGLTEFEARALEALKPQLKKSIDKGVAYAQQQPATVAMG

SEQ ID NO: 198 - DNA, 1227 bp, Medicago sativa
  CDS (1)..(1227)
atggcggcagcagcatcagctacttttactattggaaccacccaaacagggaggtcacttcctcaatctagtccttttggtttgaaattcaattcccaggttaatttcaacaccttctctggcctcaaagccatgccatctctcagatgtgactctgaatcatctttctccggcaaagaaacttgtgccgctctgcgtgcaacttttgcacccaaagctcaaaaggaaaaccgaaacctcacccgcaacttgcagcctcaggcatcctacaaagtagcggttcttggtgctgcaggagggattggtcagccactggcacttctcatcaagatgtcgcctttggtttccgacctgcatctctatgatatcgcgaatgttaagggagttgctgctgatatcagtcattgcaacaccccttcgaaagttttggatttcacaggtgcttctgagttagcaaattgtttgaaaggtgtggatgttgttgttatccctgctggtgttcctaggaagcccggcatgactcgtgacgaccttttcaacatcaatgctggtatagtcagggacttggtcactgccgttgcagataattgccccaatgcttttattcatattatcagtaatccagtgaactctacagttcctattgccgctgaaattctaaaacagaagggtgtctatgatcctaagaagctctttggtgtttctacacttgatgttgtgagggcaaacacatttgttgctcagaagaagaacctgaggttgattgatgtggatgttccagttgttggaggtcatgccgggattacaattcttcctctcttgtcaaagacaaaaccctcagtgagtttcactgatgaagaaattgaggagctaactgtcaggattcaaaacgctggaactgaggttgttgaggcgaaggctggtgcagggtctgctactttgtcaatggcttatgcagcagcaagatttgttgaatcgtctcttcgtgcacttgacggagacgctgatgtgtatgagtgctcattcgtacagtcagatctgaccgaccttccgttttttgcttcaagggtgaagattggtaggaaaggagtcgaggctttaattccaactgatctccaaggattgagtgagtatgagcagaaggctttggaagcacttaagccagaacttaaggccagcatcgagaagggggttgcttttgctcaaaagcaaactgttactgcttag

SEQ ID NO: 199 - protein, 408 aa, Medicago sativa
MAAAASATFTIGTTQTGRSLPQSSPFGLKFNSQVNFNTFSGLKAMPSLRCDSESSFSGKETCAALRATFAPKAQKENRNLTRNLQPQASYKVAVLGAAGGIGQPLALLIKMSPLVSDLHLYDIANVKGVAADISHCNTPSKVLDFTGASELANCLKGVDVVVIPAGVPRKPGMTRDDLFNINAGIVRDLVTAVADNCPNAFIHIISNPVNSTVPIAAEILKQKGVYDPKKLFGVSTLDVVRANTFVAQKKNLRLIDVDVPVVGGHAGITILPLLSKTKPSVSFTDEEIEELTVRIQNAGTEVVEAKAGAGSATLSMAYAAARFVESSLRALDGDADVYECSFVQSDLTDLPFFASRVKIGRKGVEALIPTDLQGLSEYEQKALEALKPELKASIEKGVAFAQKQTVTA

SEQ ID NO: 200 - DNA, 1242 bp, Glycine max
  CDS (1)..(1242)
atggcagcggcaccagcagctaccttcactattggaaccaccggttccctaggccaaagaggaaactcgcttcctcaattaaagtcttctgggttgaaattcaactcccagaatcatttgaagagcttctgcggcctcaaggccatgtcatccgtgagatgtgagtcagaatcgtctttcttggttaacaaaactggtgctgctctgcgggcgtcttttgcatccaaggctcaaaaggaaaacgaccaaaacttcaactacaactcgcagcctcaggcttcgtacaaagttgcagttcttggtgctgctggagggataggtcagccactcgcgcttctcatcaagatgtcgcctctaatttccgacctccatctctatgatattgcgaatgtcaagggagttgctgctgatatcagtcactgcaacaccccctcacaagtcagggatttcactggagcttctgagttggcgaattgtttgaagagtgtgaatgttgttgtcatacccgccggtgttccaaggaagcctggcatgactcgtgatgaccttttcaacatcaatgccggcatagtcagggacttggtttctgctgttgcggataatagccctgatgcttttattcaaatcatcagtaaccctgtgaactccaccgtgcctattgccgcagaagttttgaaacagaagggtgtgtatgatcctaagaagctctttggtgttaccacactggatgttgtgagggcaaacacatttgttgctcagaggaagaaccttaagctgattgatgttgatgtccccgttgttggtgggcatgccgggattaccattcttcctctgttgtcaaagaccaagccctcagcgagtttcactgatgaagaaattgaggagttgactgtcaggattcaaaatgctggaactgaagttgttgaagcaaaggcaggtgcagggtctgctaccttgtcaatggcgtatgcagcagctagatttgttgaatcgtctcttcgtgcccttgatggagatggggatgtgtatgagtgctcatatgtggaatcagatttgactgaccttccattctttgcttcaagggtgaagcttggtaggaaaggagttgaggcattaattccatctgacctccaagggttgactgactatgagcagaaggctttggaatcacttaagccagaactcatggccagcatagagaaggggattgcttttgctcagaagcaagctgttgctgcttaa

SEQ ID NO: 201 - protein, 413 aa, Glycine max
MAAAPAATFTIGTTGSLGQRGNSLPQLKSSGLKFNSQNHLKSFCGLKAMSSVRCESESSFLVNKTGAALRASFASKAQKENDQNFNYNSQPQASYKVAVLGAAGGIGQPLALLIKMSPLISDLHLYDIANVKGVAADISHCNTPSQVRDFTGASELANCLKSVNVVVIPAGVPRKPGMTRDDLFNINAGIVRDLVSAVADNSPDAFIQIISNPVNSTVPIAAEVLKQKGVYDPKKLFGVTTLDVVRANTFVAQRKNLKLIDVDVPVVGGHAGITILPLLSKTKPSASFTDEEIEELTVRIQNAGTEVVEAKAGAGSATLSMAYAAARFVESSLRALDGDGDVYECSYVESDLTDLPFFASRVKLGRKGVEALIPSDLQGLTDYEQKALESLKPELMASIEKGIAFAQKQAVAA

SEQ ID NO: 202 - DNA, 1197 bp, Pisum sativum
  CDS (1)..(1197)
atggcaacagcagcatcagcagctactttttctattggaaccgcccaaacagggaggtcactttctccatcaaacccttttggtttcaaatccaattcccaggttaatttctctggcctcaaggccatgtcatctttctctggcaacgaaacttgtgctgctcttcgtgcaacttttgctcccaaagctgtaaaagaaaaccaaaaccgaaaccacatcttgcagccacaggcatcctacaaagtagcgcttctcggtgctgccggagggattggtcagccactggcacttctcatcaagatgtcgcctttggtatccgacctgcatctctatgatatcgcgaacgttaagggagttgctgctgatattagtcattgcaacactccttcaaaagttgcggatttcacaggagctgctgagttagccaattgtttgaaaggtgtggatgttgttgttatacctgctggtgttcctaggaaacccgggatgactcgtgatgatcttttcaacatcaatgccggtatagttagagacttggtctctgccgttgcagataattgccctggggcttttattcatattattagtaatccggtgaattctactgtgcctattgctgctgaaattctgaaacaaaaaggtgtctatgatcctaaaaagctctttggtgttagcacacttgatgttgtgagggcaaacacctttgttgctcagagaaagaacttgaggctgattgatgtagatgtccctgttgttggggggcatgctgggattaccattcttcctcttttgtcaaagacaaaaccctcggcgagtttcactgatgaagaaattgaggagctgactgtcaggattcaaaatgctggaactgaagttgttgaggcaaaagctggtgcagggtctgcaactttgtcaatggcttatgcagcagctagatttgttgaatcctctcttcgtgcgcttgacggagatgctgatgtgtacgagtgctcatatgtacagtcagatctgactgaccttccgttttttgcttcaagggtgaagattggtaggaaaggagtcgaggctttcattccaactgatctccaaggattgagtgagtacgagcagaaggctttggaagcactcaagccagaacttaaggccagtatcgagaagggggttgcttttgctcaaaagcaaactgttgtcgcttaa

SEQ ID NO: 203 - protein, 398 aa, Pisum sativum
MATAASAATFSIGTAQTGRSLSPSNPFGFKSNSQVNFSGLKAMSSFSGNETCAALRATFAPKAVKENQNRNHILQPQASYKVALLGAAGGIGQPLALLIKMSPLVSDLHLYDIANVKGVAADISHCNTPSKVADFTGAAELANCLKGVDVVVIPAGVPRKPGMTRDDLFNINAGIVRDLVSAVADNCPGAFIHIISNPVNSTVPIAAEILKQKGVYDPKKLFGVSTLDVVRANTFVAQRKNLRLIDVDVPVVGGHAGITILPLLSKTKPSASFTDEEIEELTVRIQNAGTEVVEAKAGAGSATLSMAYAAARFVESSLRALDGDADVYECSYVQSDLTDLPFFASRVKIGRKGVEAFIPTDLQGLSEYEQKALEALKPELKASIEKGVAFAQKQTVVA

SEQ ID NO: 204 - DNA, 1191 bp, Oryza sativa
  CDS (1)..(1191)
atggcatcaactgttgccatcaatttgattggtgctcaggctggcattatctcaaagttaaggaattgcgacatcacaagctacagtggcttaaaggcaagatcatctattagttttgagtcaaggtcatcattcctgggtcagaatgcatctcttcgatcatctatctctccaaggattgtaccaaaggcaaactctggatctcacatttctcctgaggcatcttacaaagtggcagttctcggtgctgctggtggcattggtcaaccgttgggcttgttaattaagatgtctcctctggtctctgcactacatctgtatgatattgcaaatgtcaaaggagttgctgctgatctgagccactgcaacacaccttctcaggttctggactttactgggccctcggaattagccaactgcttgaaaggtgtggatgttgttgtcatccctgctggagtcccaaggaagccaggaatgactcgtgatgatctttttaacatcaatgcgagcattgtcaagacacttgttgaggctgttgcagacaattgtccagaagcctttatccatatcattagcaacccagtaaactcaacagtgcccattgctgctgaggttctgaaacagaagggtgtctataaccccaagaagcttttcggagttaccaccctagatgttgtcagagctaacacatttatagctcagaagaagaacctgaagctcattgatgttgatgtcccagttgttggtggtcatgctgggattactatcctaccattgctgtcaaaaaccagaccatctgtcaccttcacaaatgaggaaactgaagagctgacaaggaggatacagaatgctgggacagaggtggtggaggcgaaagctggtgctggatctgctaccctgtcgatggcctatgcagctgccagatttgttgagtcatccctccgtgcattggctggtgatccagatgtttacgagtgcacatttgttcaatctgaattaactgagctgctgttctttgcatctagggttaagcttggtaagaatggtgttgagtccatcatttcttccgaccttgagggagtgactgaatatgaggccaaggcccttgagtcattgaagcctgagttgaaggccagcattgagaagggcatcgagttcgtccacaaacagcaggctgccgctacttcttga

SEQ ID NO: 205 - protein, 396 aa, Oryza sativa
MASTVAINLIGAQAGIISKLRNCDITSYSGLKARSSISFESRSSFLGQNASLRSSISPRIVPKANSGSHISPEASYKVAVLGAAGGIGQPLGLLIKMSPLVSALHLYDIANVKGVAADLSHCNTPSQVLDFTGPSELANCLKGVDVVVIPAGVPRKPGMTRDDLFNINASIVKTLVEAVADNCPEAFIHIISNPVNSTVPIAAEVLKQKGVYNPKKLFGVTTLDVVRANTFIAQKKNLKLIDVDVPVVGGHAGITILPLLSKTRPSVTFTNEETEELTRRIQNAGTEVVEAKAGAGSATLSMAYAAARFVESSLRALAGDPDVYECTFVQSELTELLFFASRVKLGKNGVESIISSDLEGVTEYEAKALESLKPELKASIEKGIEFVHKQQAAATS

SEQ ID NO: 206 - DNA, 1041 bp, Lycopersicon esculentum
  CDS (1)..(1041)
  misc_feature (766)..(766): n is a, g, c or t
atgaggacctccatgttgaaatccatcgtccgccggagctccactgccggagcatcctatgtatctcgccgtggattcgcatcgggatccgcgccggagaggaaagttgcagttttgggggcagccggagggattggacagcctttatctcttctaatgaagcttaaccctttagtatccagcctttcactctacgatatcgccggtactcccggtgttgccgccgatgttagtcacatcaacaccagatctgaggttgccggttttgcaggagaagagcagctagggcaggcactggaaggagctgatgttgttatcattcctgctggtgtgccccgaaagcctggtatgacccgagatgatctgttcaacattaatgcgggtattgttaaatctctatgcacggccattgctaagtactgccccaatgctctggtcaatatgataagcaacccagtgaattccactgtccctattgctgctgaggtgtttaagaaagctggaacttatgatgaaaagaagctctttggagttaccatgcttgatgtggttagggccaagacattttatgctggaaaagctaaagtaaatgttgctgaggtcaatctcccagtagttggtggtcatgctggcataactatcctcccattattttctcaagccactccaaaggcaaatctatcatatgaggaaattgttgcactcacaaagcgaacccaagatggtgggacagaagttgtagaagccaaagctggaaagggttcanccaccctctcaatagcctatgctggggctatttttgccgatgcttgcttgaaggggttgaatggagttcccgatgttgttgaatgtgcttttgtgcagtccaatgtcaccgagcttcccttcttcgcatccaaggtaagacttgggaaaaatggagtggaggaagtcctagggttgggtccacttaacgactacgagaagcaaggacttgaggctcttaagccagagctgctctcctccattgaaaagggaatcaagtttgccaaagaaaactaa

SEQ ID NO: 207 - protein, 346 aa, Lycopersicon esculentum
  misc_feature (256)..(256): The Xaa at location 256 stands for Ala, Pro, Ser, or Thr.
MRTSMLKSIVRRSSTAGASYVSRRGFASGSAPERKVAVLGAAGGIGQPLSLLMKLNPLVSSLSLYDIAGTPGVAADVSHINTRSEVAGFAGEEQLGQALEGADVVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSYEEIVALTKRTQDGGTEVVEAKAGKGSXTLSIAYAGAIFADACLKGLNGVPDVVECAFVQSNVTELPFFASKVRLGKNGVEEVLGLGPLNDYEKQGLEALKPELLSSIEKGIKFAKEN

SEQ ID NO: 208 - DNA, 1041 bp, Solanum tuberosum
  CDS (1)..(1041)
atgaggacctccatgttgaaatccatcgtccgccggagctccactgccggagaatcctatgtatcccgccgtggattcgcatcgggatccgcaccagagaggaaagttgcagttttgggggcagccggagggattggacagcctttatctcttctaatgaagcttaaccctttagtatccagcctttcactctacgatatcgccggcactcccggtgttgccgccgatgttagtcacatcaacaccagatctgaggttgtcggttttgcaggagaagagcagctagggaaggctctggaaggagctgatatagttatcattcctgctggtgtgccccgaaagcctggtatgacccgagatgatctgttcaacattaatgcgggtattgttaaatctctttgcacggccattgctaagtactgccccaatgctctggtcaatatgataagcaacccagttaattccactgtcccaattgctgctgaggtgtttaagaaggctggaacttatgatgaaaagaagctctttggagttaccatgcttgatgtggttagggccaagacattttatgctggaaaagctaaagtaaatgttgctgaggtcaatcttccggtagttggtggtcatgctggcataactatcctcccattattttctcaagccactccaaaggcaaatctgtcaaatgaggaaattgttgcactcacaaagcgaacacaagatggtggcacagaagtcgtggaggccaaggctggaaagggttcagccaccctctcaatggcctatgctggggctatttttgccgatgcttgcttgaagggtttgaatggagttcccgatgttgttgaatgtgcttttgtgcagtccaatgttaccgagcttcccttctttgcatccaaggtgagacttgggaaaaatggagtggaggaagtcctagggttgggtccacttaacgagtatgagaagcaaggacttgaggctctgaagccagagctgctctcctccattgaaaagggaatcaagtttgccaaagagaactaa

SEQ ID NO: 209 - protein, 346 aa, Solanum tuberosum
MRTSMLKSIVRRSSTAGESYVSRRGFASGSAPERKVAVLGAAGGIGQPLSLLMKLNPLVSSLSLYDIAGTPGVAADVSHINTRSEVVGFAGEEQLGKALEGADIVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSNEEIVALTKRTQDGGTEVVEAKAGKGSATLSMAYAGAIFADACLKGLNGVPDVVECAFVQSNVTELPFFASKVRLGKNGVEEVLGLGPLNEYEKQGLEALKPELLSSIEKGIKFAKEN

SEQ ID NO: 210 - DNA, 1041 bp, Solanum tuberosum
  CDS (1)..(1041)
atgaggacctccatgttgaaatccatcgtccgccggagctccactgccggagcatcctatgtatcccgccgtggattcgcatcgggatccgcaccagagaggaaagttgcagttttgggggcagccggaggaattggacagcctttatctcttccaatgaagcttaaccctttagtatccagcctttcactctacgatatcgccggcactcccggtgttgccgccgatgttagtcacatcaacaccagatctgaggttgtcggttttgcaggagaagagcagctagggaaggctctggaaggagctgatatagttatcattcctgctggtgtgccccgaaagcctggtatgacccgagatgatctgttcaacattaatgcgggtattgttaaatctctttgcacggccattgctaagtactgccccaatgctctggtcaatatgataagcaacccagtgaattccactgtcccaattgctgctgaggtgtttaagaaggctggaacttatgatgaaaagaagctctttggagttaccatgcttgatgtggttagggccaagacattttatgctggaaaagctaaagtaaatgttgctgaggtcaatcttccggtagttggtggtcatgctggcataactatcctcccattattttctcaagccactccaaaggcaaatctgtcaaatgaggaaattgttgcactcacaaagcgaacacaagatggtggcacagaagtcgtggaggccaaggctggaaagggttcagccaccctctcaatggcctatgctggggctatttttgccgatgcttgcttgaagggtttgaatggagttcccgatgttgttgaatgtgcttttgtgcagtccaatgttaccgagcttcccttctttgcatccaaggtgagacttgggaaaaatggagtggaggaagtccttgggttgggtccacttaacgagtatgagaagcaaggacttgaggctctgaagccagagctgctctcctccattgaaaagggaatcaagtttgccaaagagaactaa

SEQ ID NO: 211 - protein, 346 aa, Solanum tuberosum
MRTSMLKSIVRRSSTAGASYVSRRGFASGSAPERKVAVLGAAGGIGQPLSLPMKLNPLVSSLSLYDIAGTPGVAADVSHINTRSEVVGFAGEEQLGKALEGADIVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSNEEIVALTKRTQDGGTEVVEAKAGKGSATLSMAYAGAIFADACLKGLNGVPDVVECAFVQSNVTELPFFASKVRLGKNGVEEVLGLGPLNEYEKQGLEALKPELLSSIEKGIKFAKEN

SEQ ID NO: 212 - DNA, 1065 bp, Arabidopsis thaliana
  CDS (1)..(1065)
atggagtttcgtggagatgccaaccagaggattgctaggatttcagctcatctcactcctcagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtccgcgggttcttgggagcgaagcagcttgaggacgcgctaacgggtatggatcttgtgatcataccagccggtataccgaggaaaccagggatgacccgcgatgatctgtttaaaatcaatgctgggattgttaaaacactatgtgaaggtgtagcaaaatgttgtcctaatgctattgtcaacttgatcagcaaccctgtgaactctactatccccattgccgctgaggttttcaagaaagctggaacttatgatcctaagaagctccttggagttactacactcgatgttgctcgtgccaacacatttgtggcagaagttcttggccttgatccaagagaagtcgatgtgccagtagttgggggacacgccggagtcacaatcttgccactactgtcacaggttaaacctcctagcagcttcacacctcaagaaattgagtacctgacaaaccggattcaaaatggtggaactgaagttgtggaggcaaaagctggagctggttctgcaacactttcaatggcatatgctgcagccaagtttgcagatgcttgccttcgcgggttaagaggagatgcgaatgtcgtagaatgctcttttgttgcttcacaggtgacagaattagctttctttgcaacaaaagtgcgccttggccgtacaggagcagaggaagtgtatcagcttggacccttaaacgaatacgaaaggattggtctggagaaagcaaaagatgaattagccggaagtattcagaaaggtgttgaattcatcagaaaatga

SEQ ID NO: 213 - protein, 354 aa, Arabidopsis thaliana
MEFRGDANQRIARISAHLTPQMEAKNSVIGRENCRAKGGNPGFKVAILGAAGGIGQSLSLLMKMNPLVSLLHLYDVVNAPGVTADVSHMDTGAVVRGFLGAKQLEDALTGMDLVIIPAGIPRKPGMTRDDLFKINAGIVKTLCEGVAKCCPNAIVNLISNPVNSTIPIAAEVFKKAGTYDPKKLLGVTTLDVARANTFVAEVLGLDPREVDVPVVGGHAGVTILPLLSQVKPPSSFTPQEIEYLTNRIQNGGTEVVEAKAGAGSATLSMAYAAAKFADACLRGLRGDANVVECSFVASQVTELAFFATKVRLGRTGAEEVYQLGPLNEYERIGLEKAKDELAGSIQKGVEFIRK

SEQ ID NO: 214 - DNA, 1059 bp, Vitis vinifera
  CDS (1)..(1059)
atgaaggcttcgttgttcagatctgcagaaactgctctaaggagggtctcatccccctccgcatcttcgcatctactccgccgatcttactgcgtggaatccaagccagaacgcaaggtcgccgttcttggagccgccggcggcattggacagccccttgccctcctcatgaagctcaatcctcttgtctcctcgctctctctctacgatatcgctggtactcctggcgtggccgctgatgtcagccacatcaacactcgttcccaagtcgcggggtacatgggcgacgatcagctagggcaagccttggagggagcagatttggtgattattccagccggtgttccaagaaagcccggtatgactcgtgacgatctgttcaacatcaatgccggaattgtgaagtccttatgcactgccattgccaagtactgtcccaatgcattggttaatatgataagcaaccctgtgaactcgactgtgccaattgccgctgaggttttcaagaaggctggaacttatgatgagaagaagctgtttggtgtgactacactagatgtggttagggctaagaccttctatgctgggaaggccaaggtcccagttgctgaggccaatgtaccagttgttggtggtcatgcaggcataacgatccttccactcttttctcaagccacaccgaaatccaacaatttgtcagatgaagatattgtggctctaacaaaacgaacacaagatggaggaacagaggttgtggaagccaaggctggaaaaggatctgcaaccctctcaatggcatatgctggagcagtctttgcagatgcttgcttgaaggttcttaatggcgttccagatgtagttgaatgctcttttgttcaatcaaccattgttcctgatttgccttactttgcctctaaggtaaagcttggaaagaatggtgtggaagaggtccttgggttgggtcctttgtcggactatgagaaacaaggtcttgaaagcctcaaacatgagctcaaagcctcaattgagaagggaatcaaatttgccactcaaagttaa

SEQ ID NO: 215 - protein, 352 aa, Vitis vinifera
MKASLFRSAETALRRVSSPSASSHLLRRSYCVESKPERKVAVLGAAGGIGQPLALLMKLNPLVSSLSLYDIAGTPGVAADVSHINTRSQVAGYMGDDQLGQALEGADLVIIPAGVPRKPGMTRDDLFNINAGIVKSLCTAIAKYCPNALVNMISNPVNSTVPIAAEVFKKAGTYDEKKLFGVTTLDVVRAKTFYAGKAKVPVAEANVPVVGGHAGITILPLFSQATPKSNNLSDEDIVALTKRTQDGGTEVVEAKAGKGSATLSMAYAGAVFADACLKVLNGVPDVVECSFVQSTIVPDLPYFASKVKLGKNGVEEVLGLGPLSDYEKQGLESLKHELKASIEKGIKFATQS

SEQ ID NO: 216 - DNA, 1038 bp, Glycine max
  CDS (1)..(1038)
atgatgaagccatcgatgctcagatctctccactccgccgccacccgcggcgcctctcatctcttccgccgtgggtacgcctccgagccggtgccggagcgcaaggtagccgttctcggcgccgccggcgggatcgggcagcctctctcccttctcatgaagctcaatcccctcgtttcgagcctctccctttacgatatcgccggaacccccggcgtcgccgccgatatcagccacataaacaccagatctgaggtagtggggtaccaaggtgatgaagagcttggaaaagctttggagggtgccgatgttgttataattcctgctggtgtgcccagaaagcctggaatgactcgtgatgatctttttaacatcaatgctggcattgtaaagacgctgtgtactgctattgctaagtattgcccccatgcccttgttaacatgataagcaatcctgtgaactccactgttcctattgctgctgaagttttcaagaaggcaggaacttatgatgagaagagattgtttggtgttaccacccttgatgttgttagggcaaaaactttctatgctgggaaagccaatgttccagttgctggtgttaatgtacctgttgtgggcggccatgcaggcattactattctgccactattttctcaagccacaccaaaagccaatcttgatgatgatgtcattaaggctcttacaaagaggacacaagatggaggaacagaagttgtagaagctaaggctggaaagggttctgcaactttgtcaatggcctatgctggtgccctttttgctgatgcttgcctcaagggcctcaatggagtcccagatgttgtcgagtgctctttcgtgcaatccactgttactgaacttcccttctttgcttccaaggtgaggcttgggacggttggtgtggaggaagttctgggcttggggcacctctcagattttgagcaacaaggcctcgaaagccttaagcctgaactcaaatcatcaattgagaagggaatcaaatttgccaaccagtaa

SEQ ID NO: 217 - protein, 345 aa, Glycine max
MMKPSMLRSLHSAATRGASHLFRRGYASEPVPERKVAVLGAAGGIGQPLSLLMKLNPLVSSLSLYDIAGTPGVAADISHINTRSEVVGYQGDEELGKALEGADVVIIPAGVPRKPGMTRDDLFNINAGIVKTLCTAIAKYCPHALVNMISNPVNSTVPIAAEVFKKAGTYDEKRLFGVTTLDVVRAKTFYAGKANVPVAGVNVPVVGGHAGITILPLFSQATPKANLDDDVIKALTKRTQDGGTEVVEAKAGKGSATLSMAYAGALFADACLKGLNGVPDVVECSFVQSTVTELPFFASKVRLGTVGVEEVLGLGHLSDFEQQGLESLKPELKSSIEKGIKFANQ

SEQ ID NO: 218 - DNA, 1239 bp, Nicotiana tabacum
  CDS (1)..(1239): transl_table=11
atggcagcaacatcagcaactactttctcagttggctcagccacatctcttggctgcaaaggaagctcagtatctcaatcaaaagcctttagtgtgaaattctactccaaaaacagccttaaaagtttcagcggtttgaaggctgccacagatgtaagctgtgaatcagaatcgtcctttttaggaaaagaaagtgttgctgtccttaaacaatcttttactccaaaggctcaaaaagaaaacaagggatatgggaactgtgttcagcctcaagcatcttacaaagtggctgttcttggagccagcggcggtataggccagccactgtctcttctggtcaagatgtcaccattagtttcagagctgaacctttatgatatagctaatgttaaaggagttgcggctgatctaagtcactgcaacactccctccaaggtttcagatttcactggagcttctgaattggccaactgtttgaaaggtgtaaatgtggtggtcatacctgctggtgttccgagaaagccaggtatgacacgtgatgatctgttcaacattaatgcaaacattgtgaagacattggtcgaggctgttgctgataattgccctgatgcgtttatccacatcattagcaatccagtcaactccacagtgccaattgcagcagaggtgttgaagcgaaagggtgtttatgatcctaaaaaactttttggtgttaccaccctagatgtagtcagggcaaacacatttgtcgcgcagaagaaaagtttgaggcttattgacgtagatgtcccagttgtgggtggccatgctggtatcaccattttgcctttgctatcaaagacaaaaccatccactactttcactgacgaagaagtacaggagctaactgtgaggattcaaaatgctggcacagaagttgtggaggcaaaggctggtgcagggtctgctacactttccatggcgtacgcagcagcaagatttgttgagtcctcactccgcgcacttgatggagatagtgatgtgtatgagtgtgcttttgtccagtctgacctaacagagcttccattctttgcttcaagggttaaactaggaaagaacggggttgaggctttgattccatctgaccttcaaggtttgactgagtatgaacagaaagctctggatgctttaaagccagaactgaaatctagcatcgagaagggtataggtttcgttcagaaggaacctgtagctgcttag

SEQ ID NO: 219 - protein, 412 aa, Nicotiana tabacum
MAATSATTFSVGSATSLGCKGSSVSQSKAFSVKFYSKNSLKSFSGLKAATDVSCESESSFLGKESVAVLKQSFTPKAQKENKGYGNCVQPQASYKVAVLGASGGIGQPLSLLVKMSPLVSELNLYDIANVKGVAADLSHCNTPSKVSDFTGASELANCLKGVNVVVIPAGVPRKPGMTRDDLFNINANIVKTLVEAVADNCPDAFIHIISNPVNSTVPIAAEVLKRKGVYDPKKLFGVTTLDVVRANTFVAQKKSLRLIDVDVPVVGGHAGITILPLLSKTKPSTTFTDEEVQELTVRIQNAGTEVVEAKAGAGSATLSMAYAAARFVESSLRALDGDSDVYECAFVQSDLTELPFFASRVKLGKNGVEALIPSDLQGLTEYEQKALDALKPELKSSIEKGIGFVQKEPVAA

SEQ ID NO: 220 - DNA, 1065 bp, Arabidopsis thaliana
  CDS (1)..(1065)
atggagtttcgtggagatgccaaccagaggattgctaggatttcagctcatctcactcctcagatggaggccaagaactctgtaatcggacgggaaaactgcagagctaaaggtggtaatccaggattcaaagtagcaattcttggagctgcaggtggaattggacaatctttatctttgctgatgaagatgaaccctcttgtctctttacttcatctctacgatgttgtcaatgctcctggcgtcactgctgacgtcagtcatatggacactggagctgttgtccgcgggttcttgggagcgaagcagcttgaggacgcgctaacgggtatggatcttgtgatcataccagccggtataccgaggaaaccagggatgacccgcgatgatctgtttaaaatcaatgctgggattgttaaaacactatgtgaaggtgtagcaaaatgttgtcctaatgctattgtcaacttgatcagcaaccctgtgaactctactgtccccattgccgctgaggttttcaagaaagctggaacttatgatcctaagaagctccttggagttactacactcgatgttgctcgtgccaacacatttgtggcagaagttcttggccttgatccaagagaagtcgatgtgccagtagttgggggacacgccggagtcacaatcttgccactactgtcacaggttaaacctcctagcagcttcacacctcaagaaattgagtacctgacaaaccggattcaaaatggtggaactgaagttgtggaggcaaaagctggagctggttctgcaacactttcaatggcatatgctgcagccaagtttgcagatgcttgccttcgcgggttaagaggagatgcgaatgtcgtagaatgctcttttgttgcttcacaggtgacagaattagctttctttgcaacaaaagtgcgccttggccgtacaggagcagaggaagtgtatcagcttggacccttaaacgaatacgaaaggattggtctggagaaagcaaaagatgaattagccggaagtattcagaaaggtgttgaattcatcagaaaatga

SEQ ID NO: 221 - protein, 354 aa, Arabidopsis thaliana
MEFRGDANQRIARISAHLTPQMEAKNSVIGRENCRAKGGNPGFKVAILGAAGGIGQSLSLLMKMNPLVSLLHLYDVVNAPGVTADVSHMDTGAVVRGFLGAKQLEDALTGMDLVIIPAGIPRKPGMTRDDLFKINAGIVKTLCEGVAKCCPNAIVNLISNPVNSTVPIAAEVFKKAGTYDPKKLLGVTTLDVARANTFVAEVLGLDPREVDVPVVGGHAGVTILPLLSQVKPPSSFTPQEIEYLTNRIQNGGTEVVEAKAGAGSATLSMAYAAAKFADACLRGLRGDANVVECSFVASQVTELAFFATKVRLGRTGAEEVYQLGPLNEYERIGLEKAKDELAGSIQKGVEFIRK

SEQ ID NO: 222 - DNA, 1077 bp, Brassica napus
  CDS (1)..(1077)
atggagttccgtggagatgcctacaagaggattgctatgatatcagctcatcttcaaccttctttcactcctcagatggaggccaagaactctgtgatgggactagaaagctgcagagcgaaaggagggaatccaggattcaaagtagccattcttggagctgcaggtggaataggacaatcactatccttgttaatgaagatgaaccctctcgtctctttacttcatctctacgatgtcgtcaatgctcctggagtcactgctgacgttagccatatggacactggagccgttgttagaggattcttgggagccaagcaacttgaggacgccctaactggtatggatcttgtgatcataccagctggtgtgccgaggaaaccagggatgacacgtgatgatctttttaaaatcaacgctgggattgttaggacactatgtgaaggagtagctaaatgctgtcctaatgctattgttaacttgattagtaaccctgtgaactctactgttgctattgctgctgaggttttcaagaaagctggaacttatgatcctaagaagctccttggtgttactacactagatgttgctcgtgccaacacatttgtggctgaagttcttggccttgatccaagagaagtcgatgtaccagtcgttggaggacatgctggagtcacaatcttgccactattgtcacaggttaaacctcctagcagcttcacaccatcagagattgagtaccttacaaacaggattcaaaacggtggaactgaagttgtggaggcaaaagctggagctggatctgcaacactttcaatggcatatgctgcagccaagttcgcagatgcttgccttcgcgggttaagaggagatgcgaatgtcattgaatgctcttttgttgcttcacaggtgacagagttagctttctttgcaaccaaagtgcgtcttggacgtacaggagcagaggaagtgtttcagcttgggcccttgaacgaatacgaaagggttggtctggagaaagcaaaagaagaactagctggaagcattcagaaaggtgtcgacttcatcaggaaatga

SEQ ID NO: 223 - protein, 358 aa, Brassica napus
MEFRGDAYKRIAMISAHLQPSFTPQMEAKNSVMGLESCRAKGGNPGFKVAILGAAGGIGQSLSLLMKMNPLVSLLHLYDVVNAPGVTADVSHMDTGAVVRGFLGAKQLEDALTGMDLVIIPAGVPRKPGMTRDDLFKINAGIVRTLCEGVAKCCPNAIVNLISNPVNSTVAIAAEVFKKAGTYDPKKLLGVTTLDVARANTFVAEVLGLDPREVDVPVVGGHAGVTILPLLSQVKPPSSFTPSEIEYLTNRIQNGGTEVVEAKAGAGSATLSMAYAAAKFADACLRGLRGDANVIECSFVASQVTELAFFATKVRLGRTGAEEVFQLGPLNEYERVGLEKAKEELAGSIQKGVDFIRK

SEQ ID NO: 224 - DNA, 1077 bp, Brassica napus
  CDS (1)..(1077)
atggagtttcgtggagatgccaacaagaggattgctatgatatcagctcatcttcaaccttctttcactcctcagatggaggccaagaactctgtaatgggacgagaaaactgcagagcgaaaggagggaatccaggattcaaagtagctattcttggagcggcaggtggaataggacagtctctatccttgttaatgaagatgaaccctctcgtctctttacttcatctctacgatgttgtcaatgctcctggagtcactgctgatgttagccatatggacactggagctgttgttagaggattcttgggagccaagcaactcgaggacgccctaaccggtatggatcttgtgatcataccagctggtgtgccgaggaaaccagggatgacacgtgatgatctctttaaaatcaatgctgggattgttaagacactatgtgaaggagtagcgaaatgctgtcctaatgctatagttaacttgattagcaaccctgtgaactctactgtcgctattgctgctgaggttttcaagaaagctggaacttatgatcctaagaaactccttggagttactacacttgatgttgctcgtgccaacacatttgtggctgaagttcttggccttgatccaagagaagtcgatgtaccagtggttggaggacatgctggagtcacaatattgccactgttgtcacaggttaaacctccaagcagcttcacaccttcagagattgagtacctcacaaacaggattcaaaacggtggaactgaagttgtggaggcaaaagctggagctggatctgcaacactttcaatggcatatgctgcagccaagtttgcagatgcttgccttcgcgggttaagaggagatgcgaatgtcattgaatgctcttttgttgcttcacaggtgacagagttagcattctttgcaaccaaagtgcgtcttggacgtacaggagcagaggaagtgttccagcttgggcccttgaacgaatatgaaagggttggtctggagaaagcaaaagaagaactagctggaagtattcagaaaggtgtcgacttcatcaggaaatga

SEQ ID NO: 225 - protein, 358 aa, Brassica napus
MEFRGDANKRIAMISAHLQPSFTPQMEAKNSVMGRENCRAKGGNPGFKVAILGAAGGIGQSLSLLMKMNPLVSLLHLYDVVNAPGVTADVSHMDTGAVVRGFLGAKQLEDALTGMDLVIIPAGVPRKPGMTRDDLFKINAGIVKTLCEGVAKCCPNAIVNLISNPVNSTVAIAAEVFKKAGTYDPKKLLGVTTLDVARANTFVAEVLGLDPREVDVPVVGGHAGVTILPLLSQVKPPSSFTPSEIEYLTNRIQNGGTEVVEAKAGAGSATLSMAYAAAKFADACLRGLRGDANVIECSFVASQVTELAFFATKVRLGRTGAEEVFQLGPLNEYERVGLEKAKEELAGSIQKGVDFIRK

SEQ ID NO: 226 - DNA, 1071 bp, Oryza sativa
  CDS (1)..(1071)
atggaggacgcagcagcagcagcaaggcggatggagaggcttgcctcccacctccgcccgcccgcttctcagatggaggaatcacccctcctgaggggctccaattgccgggcaaaaggtgccgctccgggtttcaaggtcgccatcttgggagcgtctggtgggattggccagcctcttgcattgctcatgaagatgaaccctcttgtttctgtgctccatctgtacgatgttgtcaacactcccggtgtcacagctgacattagccacatgaacactggtgctgtggtgcgtggtttcttgggccagccacagttggaaaatgcccttactggaatggatcttgtgatcattcctgctggtgttcctcgtaagcctgggatgacaagggatgatttgttcaacatcaatgccggaatcgtccggactctttgtgaaggaatcgcaaaatgctgccccaatgcaattgtgaatgtgatcagcaaccctgtcaattctactgttccgattgctgctgaggtttttaagaaagctgggacatatgaccctaagcgccttttgggggtgacgacacttgatgtagtgagagccaatacttttgtggcagaagttcttgggcttgaccccagagatgtaaatgtccctgtcattggtgggcatgcaggagtaacaatattaccactcctttcacaggtgaatcctccctgctcattcacctcagaagaaattagttatcttaccactcgcatacagaatggtgggacagaagtagtcgaggctaaagctggagcggggtctgcaaccctttcaatggcgtatgcagcttctaaatttgcagatgcttgcttgagaggattgcgtggcgacgctgggatagtggagtgctcttttgtagcttctcaggtgacagagctgcctttctttgcatccaaagtgcggttaggtcgctgtggcatcgaggagatcttatcacttggtccattgaatgaattcgaaagagctggactggagaaggctaagaaggagctggccgagagtatccaaaagggggtcgctttcatcaacaagtga

SEQ ID NO: 227 - protein, 356 aa, Oryza sativa
MEDAAAAARRMERLASHLRPPASQMEESPLLRGSNCRAKGAAPGFKVAILGASGGIGQPLALLMKMNPLVSVLHLYDVVNTPGVTADISHMNTGAVVRGFLGQPQLENALTGMDLVIIPAGVPRKPGMTRDDLFNINAGIVRTLCEGIAKCCPNAIVNVISNPVNSTVPIAAEVFKKAGTYDPKRLLGVTTLDVVRANTFVAEVLGLDPRDVNVPVIGGHAGVTILPLLSQVNPPCSFTSEEISYLTTRIQNGGTEVVEAKAGAGSATLSMAYAASKFADACLRGLRGDAGIVECSFVASQVTELPFFASKVRLGRCGIEEILSLGPLNEFERAGLEKAKKELAESIQKGVAFINK

SEQ ID NO: 228 - DNA, 1026 bp, Arabidopsis thaliana
  CDS (1)..(1026)
atgttcagatctatgctcgtccgatcttctgcctccgcgaagcaggcggttatccgccgtagcttctcctccggctccgtccccgagcgtaaagtcgccatccttggtgccgccggtggaattggtcagcctcttgctctcctcatgaagcttaatcctcttgtctcttccctctccctctacgatatcgctaacactcctggagttgctgctgatgttggtcacatcaacaccagatctgaggttgttggatacatgggcgatgataacttggccaaagctcttgaaggagctgatctcgttatcattccagctggtgtaccaaggaagcctggtatgacccgtgacgatcttttcaacattaatgctggaattgtcaagaacctttgcactgccatcgccaagtactgcccacatgcgcttattaatatgatcagcaaccctgtgaactctactgttccaattgcagctgagatatttaagaaggctggtatgtacgatgaaaagaaattgtttggtgttaccactcttgacgtcgtcagggccaggactttctatgctggaaaggcaaatgtcccagttgcagaagttaatgttccggtgattggtggtcatgctggggttactattctccctctcttctctcaggcaactcctcaagccaacttgtcaagtgacatacttaccgcccttactaagcgtacccaagatggaggtacagaagtcgtggaggcaaaagcaggaaaaggttcagctacattgtccatggcctatgccggagcattgttcgctgatgcatgcttgaaaggactcaacggtgttccagatgtcatagaatgctcatacgtgcaatctacaatcaccgagcttcctttctttgcctcgaaggtgaggttggggaagaatggtgtggaggaggttcttgacttgggaccactctcagactttgagaaggaaggcttggaagcattgaagccagaactcaagtcctccatagaaaagggagtcaagtttgccaaccagtga

SEQ ID NO: 229 - protein, 341 aa, Arabidopsis thaliana
MFRSMLVRSSASAKQAVIRRSFSSGSVPERKVAILGAAGGIGQPLALLMKLNPLVSSLSLYDIANTPGVAADVGHINTRSEVVGYMGDDNLAKALEGADLVIIPAGVPRKPGMTRDDLFNINAGIVKNLCTAIAKYCPHALINMISNPVNSTVPIAAEIFKKAGMYDEKKLFGVTTLDVVRARTFYAGKANVPVAEVNVPVIGGHAGVTILPLFSQATPQANLSSDILTALTKRTQDGGTEVVEAKAGKGSATLSMAYAGALFADACLKGLNGVPDVIECSYVQSTITELPFFASKVRLGKNGVEEVLDLGPLSDFEKEGLEALKPELKSSIEKGVKFANQ

SEQ ID NO: 230 - protein, 316 aa, Artificial sequence
  Description of artificial sequence: consensus sequence
  Variant (4)..(4): Xaa in position 4 is any amino acid
  Variant (16)..(16): Xaa in position 16 is any amino acid
  Variant (19)..(19): Xaa in position 19 is any amino acid
  Variant (21)..(21): Xaa in position 21 is any amino acid
  Variant (22)..(22): Xaa in position 22 is any or no amino acid
  Variant (27)..(27): Xaa in position 27 is any amino acid
  Variant (29)..(29): Xaa in position 29 is any amino acid
  Variant (33)..(37): Xaa in position 33 to 37 is any amino acid
  Variant (40)..(40): Xaa in position 40 is any amino acid
  Variant (43)..(43): Xaa in position 43 is any amino acid
  Variant (46)..(46): Xaa in position 46 is any amino acid
  Variant (49)..(51): Xaa in position 49 to 51 is any amino acid
  Variant (53)..(54): Xaa in position 53 to 54 is any amino acid
  Variant (56)..(56): Xaa in position 56 is any amino acid
  Variant (58)..(60): Xaa in position 58 to 60 is any amino acid
  Variant (62)..(64): Xaa in position 62 to 64 is any amino acid
  Variant (66)..(66): Xaa in position 66 is any amino acid
  Variant (68)..(68): Xaa in position 68 is any amino acid
  Variant (70)..(70): Xaa in position 70 is any amino acid
  Variant (72)..(72): Xaa in position 72 is any amino acid
  Variant (94)..(94): Xaa in position 94 is any amino acid
  Variant (97)..(98): Xaa in position 97 to 98 is any amino acid
  Variant (100)..(103): Xaa in position 100 to 103 is any amino acid
  Variant (105)..(106): Xaa in position 105 to 106 is any amino acid
  Variant (109)..(109): Xaa in position 109 is any amino acid
  Variant (111)..(114): Xaa in position 111 to 114 is any amino acid
  Variant (130)..(130): Xaa in position 130 is any amino acid
  Variant (132)..(133): Xaa in position 132 to 133 is any amino acid
  Variant (135)..(135): Xaa in position 135 is any amino acid
  Variant (137)..(138): Xaa in position 137 to 138 is any amino acid
  Variant (142)..(142): Xaa in position 142 is any amino acid
  Variant (153)..(153): Xaa in position 153 is any amino acid
  Variant (156)..(156): Xaa in position 156 is any amino acid
  Variant (158)..(166): Xaa in position 158 to 166 is any amino acid
  Variant (168)..(168): Xaa in position 168 is any amino acid
  Variant (178)..(178): Xaa in position 178 is any amino acid
  Variant (184)..(184): Xaa in position 184 is any amino acid
  Variant (186)..(188): Xaa in position 186 to 188 is any amino acid
  Variant (190)..(195): Xaa in position 190 to 195 is any amino acid
  Variant (196)..(196): Xaa in position 196 is any or no amino acid
  Variant (199)..(201): Xaa in position 199 to 201 is any amino acid
  Variant (204)..(204): Xaa in position 204 is any amino acid
  Variant (206)..(206): Xaa in position 206 is any amino acid
  Variant (208)..(209): Xaa in position 208 to 209 is any amino acid
  Variant (220)..(220): Xaa in position 220 is any amino acid
  Variant (222)..(223): Xaa in position 222 to 223 is any amino acid
  Variant (233)..(233): Xaa in position 233 is any amino acid
  Variant (235)..(235): Xaa in position 235 is any amino acid
  Variant (237)..(240): Xaa in position 237 to 240 is any amino acid
  Variant (242)..(243): Xaa in position 242 to 243 is any amino acid
  Variant (245)..(245): Xaa in position 245 is any amino acid
  Variant (247)..(249): Xaa in position 247 to 249 is any amino acid
  Variant (251)..(251): Xaa in position 251 is any amino acid
  Variant (254)..(255): Xaa in position 254 to 255 is any amino acid
  Variant (257)..(257): Xaa in position 257 is any amino acid
  Variant (259)..(260): Xaa in position 259 to 260 is any amino acid
  Variant (262)..(262): Xaa in position 262 is any amino acid
  Variant (263)..(263): Xaa in position 263 is any or no amino acid
  Variant (270)..(270): Xaa in position 270 is any amino acid
  Variant (272)..(272): Xaa in position 272 is any amino acid
  Variant (275)..(276): Xaa in position 275 to 276 is any amino acid
  Variant (280)..(290): Xaa in position 280 to 290 is any amino acid
  Variant (291)..(294): Xaa in position 291 to 294 is any or no amino acid
  Variant (296)..(298): Xaa in position 296 to 298 is any amino acid
  Variant (301)..(302): Xaa in position 301 to 302 is any amino acid
  Variant (304)..(304): Xaa in position 304 is any amino acid
  Variant (307)..(308): Xaa in position 307 to 308 is any amino acid
  Variant (311)..(311): Xaa in position 311 is any amino acid
  Variant (314)..(315): Xaa in position 314 to 315 is any amino acid
KVAXLGAAGGIGQPLXLLXKXXPLVSXLXLYDXXXXXGVXADXSHXNTXXXVXXFXGXXXLXXXLXGXDXVXIPAGVPRKPGMTRDDLFNINAXIVXXLXXXXAXXCPXAXXXXISNPVNSTVPIAAEVXKXXGXYXXKKLXGVTTLDVVRAXTFXAXXXXXXXXXVXVPVVGGHAGXTILPLXSXXXPXXXXXXXEEXXXLTXRXQXXGTEVVEAKAGXGXXSATLSMAYAXAXFXXXXLXXLXGXXXVXECXXVXSXXTXXLPFFASXVXLGXXGVEXXXXXXXXXXXXXXXEXXXLEXXKXELXXSIXKGXXF

SEQ ID NO: 231 - protein, 58 aa, Artificial sequence
  Description of artificial sequence: amino acid sequence pattern comprised in a variant of SEQ ID NO: 159
  Variant (17)..(17): Xaa in position 17 is Gly, Asn or Ser
  Variant (20)..(20): Xaa in position 20 is Lys or Arg
  Variant (21)..(21): Xaa in position 21 is Ala, Asp, Gly, Asn, Ser or Thr
  Variant (23)..(23): Xaa in position 23 is any amino acid
  Variant (24)..(24): Xaa in position 24 is Glu, Ser or Thr
  Variant (25)..(25): Xaa in position 25 is Ala or Gly
  Variant (26)..(26): Xaa in position 26 is Ile or Val
  Variant (28)..(28): Xaa in position 28 is Asp, Glu or Lys
  Variant (29)..(29): Xaa in position 29 is any amino acid
  Variant (32)..(32): Xaa in position 32 is any amino acid
  Variant (34)..(34): Xaa in position 34 is Phe, Ile or Leu
  Variant (35)..(35): Xaa in position 35 is Ile or Val
  Variant (36)..(36): Xaa in position 36 is any amino acid
  Variant (37)..(37): Xaa in position 37 is Ile, Met or Val
  Variant (52)..(52): Xaa in position 52 is Ile or Val
  Variant (53)..(53): Xaa in position 53 is Phe or Leu
  Variant (55)..(55): Xaa in position 55 is any or no amino acid
  Variant (57)..(57): Xaa in position 57 is Ala or Gly
  Variant (58)..(58): Xaa in position 58 is Gly or Val
PRKPGMTRDDLFNINAXIVXXLXXXXAXXCPXAXXXXISNPVNSTVPIAAEXXKXKXX

SEQ ID NO: 232 - protein, 43 aa, Artificial sequence
  Description of artificial sequence: amino acid sequence pattern comprised in a variant of SEQ ID NO: 159
  Variant (2)..(2): Xaa in position 2 is any amino acid
  Variant (13)..(13): Xaa in position 13 is any or no amino acid
  Variant (15)..(15): Xaa in position 15 is any amino acid
  Variant (16)..(16): Xaa in position 16 is any or no amino acid
  Variant (18)..(18): Xaa in position 18 is Ala or Val
  Variant (19)..(19): Xaa in position 19 is Asp, Glu or Asn
  Variant (20)..(20): Xaa in position 20 is Ala or Ser
  Variant (21)..(21): Xaa in position 21 is Cys or Ser
  Variant (23)..(23): Xaa in position 23 is Lys or Arg
  Variant (24)..(24): Xaa in position 24 is Ala, Gly or Val
  Variant (26)..(26): Xaa in position 26 is any amino acid
  Variant (28)..(28): Xaa in position 28 is Asp or Val
  Variant (29)..(29): Xaa in position 29 is Ala, Gly, Pro or Ser
  Variant (30)..(30): Xaa in position 30 is Asp, Gly or Asn
  Variant (31)..(31): Xaa in position 31 is Ile or Val
  Variant (32)..(32): Xaa in position 32 is any amino acid
  Variant (35)..(35): Xaa in position 35 is Ala, Ser or Thr
  Variant (36)..(36): Xaa in position 36 is Phe or Tyr
  Variant (38)..(38): Xaa in position 38 is Ala, Asp, Glu or Gln
  Variant (40)..(40): Xaa in position 40 is Asp, Glu, Asn, Gln or Thr
  Variant (41)..(41): Xaa in position 41 is Ile, Leu or Val
  Variant (42)..(42): Xaa in position 42 is Thr or Val
  Variant (43)..(43): Xaa in position 43 is Asp, Glu or Pro
GXGSATLSMAYAXAXXFXXXXLXXLXGXXXXXECXXVXSXXXX

SEQ ID NO: 233 - protein, 25 aa, Artificial sequence
  Description of artificial sequence: amino acid sequence pattern comprised in a variant of SEQ ID NO: 159
  Variant (2)..(2): Xaa in position 2 is any or no amino acid
  Variant (4)..(4): Xaa in position 4 is any amino acid
  Variant (6)..(6): Xaa in position 6 is any amino acid
  Variant (10)..(10): Xaa in position 10 is Ile or Val
  Variant (11)..(11): Xaa in position 11 is Ala or Val
  Variant (12)..(12): Xaa in position 12 is Gly or Asn
  Variant (13)..(13): Xaa in position 13 is Thr or Val
  Variant (14)..(14): Xaa in position 14 is any amino acid
  Variant (17)..(17): Xaa in position 17 is Ala or Thr
  Variant (20)..(20): Xaa in position 20 is Ile, Leu or Val
  Variant (23)..(23): Xaa in position 23 is any amino acid
  Variant (25)..(25): Xaa in position 25 is Ala, Ser or Thr
LXSXLXLYDXXXXXGVXADXSHXNX

SEQ ID NO: 234 - protein, 59 aa, Artificial sequence
  Description of artificial sequence: amino acid sequence pattern comprised in a variant of SEQ ID NO: 159
  Variant (4)..(4): Xaa in position 4 is Phe or Leu
  Variant (7)..(7): Xaa in position 7 is any or no amino acid
  Variant (9)..(9): Xaa in position 9 is any or no amino acid
  Variant (13)..(13): Xaa in position 13 is Ala or Val
  Variant (16)..(16): Xaa in position 16 is any amino acid
  Variant (19)..(19): Xaa in position 19 is any amino acid
  Variant (20)..(20): Xaa in position 20 is Ala or Ser
  Variant (21)..(21): Xaa in position 21 is Glu, Gly or Gln
  Variant (22)..(24): Xaa in position 22 to 24 is any amino acid
  Variant (25)..(25): Xaa in position 25 is Leu or Val
  Variant (26)..(26): Xaa in position 26 is any amino acid
  Variant (27)..(27): Xaa in position 27 is Leu, Pro or Val
  Variant (28)..(28): Xaa in position 28 is any amino acid
  Variant (29)..(29): Xaa in position 29 is Asp or Glu
  Variant (31)..(31): Xaa in position 31 is Asp or Asn
  Variant (32)..(32): Xaa in position 32 is Leu or Val
  Variant (35)..(35): Xaa in position 35 is Ile or Val
  Variant (41)..(41): Xaa in position 41 is Ile or Val
  Variant (47)..(47): Xaa in position 47 is Phe or Leu
  Variant (49)..(49): Xaa in position 49 is any amino acid
  Variant (50)..(50): Xaa in position 50 is Ala, Thr or Val
  Variant (51)..(51): Xaa in position 51 is any amino acid
  Variant (53)..(53): Xaa in position 53 is any amino acid
  Variant (54)..(54): Xaa in position 54 is Ala, Ser, Thr or Val
  Variant (55)..(55): Xaa in position 55 is Asn, Ser or Thr
  Variant (56)..(58): Xaa in position 56 to 58 is any amino acid
  Variant (59)..(59): Xaa in position 59 is Asp, Glu, Gln or Ser
KKLXGVXTXLDVXRAXTFXXXXXXXXXXXVXXPVXGGHAGXTILPLXSXXXPXXXXXXX

SEQ ID NO: 235 - protein, 31 aa, Artificial sequence
  Description of artificial sequence: amino acid sequence pattern comprised in a variant of SEQ ID NO: 159
  Variant (2)..(2): Xaa in position 2 is any or no amino acid
  Variant (4)..(7): Xaa in position 4 to 7 is any amino acid
  Variant (8)..(8): Xaa in position 8 is any or no amino acid
  Variant (10)..(11): Xaa in position 10 to 11 is any amino acid
  Variant (12)..(12): Xaa in position 12 is Ala or Gly
  Variant (15)..(15): Xaa in position 15 is any amino acid
  Variant (16)..(16): Xaa in position 16 is Ala or Leu
  Variant (18)..(18): Xaa in position 18 is any amino acid
  Variant (21)..(21): Xaa in position 21 is any amino acid
  Variant (22)..(22): Xaa in position 22 is Ala, Glu, Gly or Ser
  Variant (25)..(25): Xaa in position 25 is Asp, Glu or Gln
  Variant (28)..(28): Xaa in position 28 is Ile or Val
  Variant (29)..(29): Xaa in position 29 is any amino acid
  Variant (31)..(31): Xaa in position 31 is Ala, Ile or Val
LXGXXXXXEXXXLEXXKXELXXSIXKGXXFX

SEQ ID NO: 236 - protein, 21 aa, Artificial sequence
  Description of artificial sequence: amino acid sequence pattern comprised in a variant of SEQ ID NO: 159
  Variant (2)..(2): Xaa in position 2 is Ile, Leu or Val
  Variant (6)..(6): Xaa in position 6 is Ala or Ser
  Variant (14)..(14): Xaa in position 14 is Ala, Gly or Ser
  Variant (17)..(17): Xaa in position 17 is Ile, Met or Val
  Variant (19)..(19): Xaa in position 19 is Leu or Met
  Variant (20)..(20): Xaa in position 20 is Asn or Ser
AXLGAXGGIGQPLXLLXKXXP

SEQ ID NO: 237 - protein, 23 aa, Artificial sequence
  Description of artificial sequence: amino acid sequence pattern comprised in a variant of SEQ ID NO: 159
  Variant (2)..(2): Xaa in position 2 is any amino acid
  Variant (4)..(5): Xaa in position 4 to 5 is any amino acid
  Variant (6)..(6): Xaa in position 6 is Glu or Gln
  Variant (8)..(9): Xaa in position 8 to 9 is any or no amino acid
  Variant (11)..(12): Xaa in position 11 to 12 is any or no amino acid
  Variant (14)..(14): Xaa in position 14 is any amino acid
  Variant (15)..(15): Xaa in position 15 is Asp or Gly
  Variant (16)..(16): Xaa in position 16 is any amino acid
  Variant (17)..(17): Xaa in position 17 is Asp or Asn
  Variant (18)..(18): Xaa in position 18 is Ile, Leu or Val
  Variant (20)..(20): Xaa in position 20 is Ile or Val
FXGXXXLXXAXXLXXXXXVXIPA

SEQ ID NO: 238 - DNA, 1257 bp, Arabidopsis thaliana
  CDS (1)..(1257)
atggcgtctcttctcggaagatctccttcttcaatcttgacctgccctcgtatttcttctccttcctcaacatcttcaatgtcccatctctgcttcggaccagagaaactttctggaagaatccaattcaatccaaagaagaacagatctcgttaccatgtctctgttatgaatgtcgctacagagatcaactctgttgaacaagcaaagaagattgattcaaaggaaagtgcaagacctgtttatccgtttgctgctatagttggacaagatgagatgaagctatgccttttgttaaatgtgattgacccgaagataggtggtgtgatgataatgggagatagaggaactggtaaatcaacaactgttagatctttagttgatttgcttcctgagatcactgttgtttctggtgatccgtataactcagacccgagagatcctgagtgtatgggaaaggaagtaagagagaaagttcaaaagggagaagaattgtctgttattgaaaccaaaatcaatatggttgatcttcctttgggtgctactgaagatagagtttgtggaactattgatatcgaaaaggctttaaccgaaggtgttaaggcgtttgagcctggactactagctaaagctaatagagggattctttatgttgatgaagttaatcttttggatgatcatttagttgatgttcttcttgattcagctgcatctggttggaacactgttgaaagagaagggatatcgatttctcatcctgctcggtttatcctcattggttcaggaaatcctgaagaaggagagcttagaccacagcttcttgacaggtttggtatgcacgcgcaagtagggacggttagagacgccgagctgagagttaagattgttgaagaacgagctcgtttcgatagtaacccaaaggagtttcgagaaacttatcaagaagaacaactgaagcttcaggagcagattacaactgcaagaagcaatctttctgcagttcagattgatcaagatttgaaagtgaagatctctaaggtctgtgctgagctggacgttgatggattgagaggagacatggtgataaacagagcagctagagcgcttgcagcactccaaggaagagatcaagttacagctgaagatgttggtattgttataccgaattgtttgagacacagactcagaaaagatccattggagtctatggattcgggaattctcgttaccgagaagttctatgaggttttcacttag

SEQ ID NO: 239 - protein, 418 aa, Arabidopsis thaliana
MASLLGRSPSSILTCPRISSPSSTSSMSHLCFGPEKLSGRIQFNPKKNRSRYHVSVMNVATEINSVEQAKKIDSKESARPVYPFAAIVGQDEMKLCLLLNVIDPKIGGVMIMGDRGTGKSTTVRSLVDLLPEITVVSGDPYNSDPRDPECMGKEVREKVQKGEELSVIETKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDSNPKEFRETYQEEQLKLQEQITTARSNLSAVQIDQDLKVKISKVCAELDVDGLRGDMVINRAARALAALQGRDQVTAEDVGIVIPNCLRHRLRKDPLESMDSGILVTEKFYEVFT

SEQ ID NO: 240 - DNA, 2119 bp, Glycine max
  CDS (467)..(1957)
agatcaacactttcacgcaatcgatatctcatatatgttttggttaattaatttgatccaacctcatttagcatgttctttagcatccaattgaaaacataagaaagaaaaaaactagtgcatatataattggctttgattaaacataagttaccatgaaactatgagtggctatggattatgctttaaagaaacattaatacgtacacagctgttcacaatttgatatatagtgaaacgcaatagtctcacgtacgaacgaagcatgcatgctcagtcttcgaaagttttgcactcaatggtctccgggttgtccttgcagtaattctcgagcgggtcggagtccttttccttttgcttgtccctggcgtggctcgccgccgcgctcagctcctccacctcgtcccacgccgccacgcactcgccgctcgtcggatcgccggcgcacgcctcctgcgcgttctttatgctctcctccaccttctccgatatgcgctcaggcgcagcgcgaacgggtcggatcctcatcacgcgacccaacttgatactacccggtcgcactgcttggctgggtggaagtgagaactttacagcatgcgcgttttgcggtgaggctgatgcgttgaagaaaaccctggggcatgaaaggctcacaccagtcatagttgccattctcttctcttctccggttatggcgtccgccttgggcacttcttcaattgcggttctgccttcgcgctacttctcttcttcttcttccaagccttccattcacactctctctctaacttcagggcagaactatgggcggaagttttatggaggaattggaatccatggcataaagggaagggctcagctctcggttaccaatgttgccactgaagttaactctgtagaacaggctcagagtattgcttctaaagaaagccagaggccagtatacccattttctgccatagttggacaagatgagatgaagctttgtcttctccttaatgtgattgatcctaagattggaggtgtaatgatcatgggggataggggcacagggaaatctacaacggtcaggtcattggttgatttacttcccgaaatcaaggttgttgctggtgacccttataactcagacccacaagatccagaattcatgggtgttgaagtcagagagcgtgtacttcaaggagaggaactttctgttgtcttgaccaaaattaacatggttgatttgccattgggagctacagaagatagagtgtgtggaacgattgacattgagaaagccctgactgagggtgtcaaggcatttgagcctggactactggctaaagctaataggggaatcttatatgttgatgaagttaatcttttggatgatcacttggtggatgtgttgttggattctgctgcatcaggatggaacacagtagagagagagggaatttctatctcgcatcctgcacggtttatcctaattggctcaggcaaccccgaagaaggggagctccggccgcagctgctagataggtttggaatgcatgctcaagttggaactgttagggatgctgagctcagagtgaagattgtggaggagagaggtcgatttgacaaaaatccaaaggaatttcgagattcttacaaagctgagcaagagaagctccaacaacaaattacctcagcaaggagtgttctttcttctgttcaaattgatcaagatctcaaggtgaaaatctccaaggtgtgtgctgagttgaatgtggatggattaagaggagacatagtaacaaatagagctgcaaaagctctggctgctctgaagggaagagacaacgtaagtgccgaggatattgctactgtcatccctaactgcttgagacaccgtcttagaaaggatcccttggagtctatagactcaggtttacttgtcactgagaaattttatgaggtattcagctgaggatcatagatgtaacacggtttgtattctgtggtattccatgagtataatgctacttcattatttacattttaccttttctgtggagattttcattgtcgttaaacatcaataagattcatgagttccttctacacaggaaattccgagcatttaacgtgc

SEQ ID NO: 241 - protein, 496 aa, Glycine max
MLSSTFSDMRSGAARTGRILITRPNLILPGRTAWLGGSENFTACAFCGEADALKKTLGHERLTPVIVAILFSSPVMASALGTSSIAVLPSRYFSSSSSKPSIHTLSLTSGQNYGRKFYGGIGIHGIKGRAQLSVTNVATEVNSVEQAQSIASKESQRPVYPFSAIVGQDEMKLCLLLNVIDPKIGGVMIMGDRGTGKSTTVRSLVDLLPEIKVVAGDPYNSDPQDPEFMGVEVRERVLQGEELSVVLTKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERGRFDKNPKEFRDSYKAEQEKLQQQITSARSVLSSVQIDQDLKVKISKVCAELNVDGLRGDIVTNRAAKALAALKGRDNVSAEDIATVIPNCLRHRLRKDPLESIDSGLLVTEKFYEVFS

SEQ ID NO: 242 - DNA, 1436 bp, Glycine max
  CDS (17)..(1252)
aaaagaatggcgtccgatgtttggcacatcttcaattgccttcctctcttcacgataccactcttcccaatcccttgccaccaattctccctctctaaccacagtgcaggtatttgggcgcaagttttgcggaggaaatggatttcacggcgtcaaggttacaagtgttgttgccactcaacttaactctgcacaacaggctcagaagattgcttttaacgagagccagaggccggtgtacccattttctgctatagtgggacaggatgagatgaagctttgccttctcctaaatgtaattgatcccaagattggaggtgtaatgatcatgggggacagaggaacggggaaatctacaactgttagatcattggtagatttgcttcctgaaatcaaggttgttgctggtgacccatataattcagacccagaggatccagaattcatgggtgttgaagtgagagagcgtgtgataaaaggagagcagcttcaggttgtcttctccaaaattaacatggtggatttgccattgggagctacagaagatagagtctgcgggacaattgacattgagaaggccctcactgagggtgtaaaggcatttgagccaggtctactggctaaagctaataggggaattctgtatgttgatgaagttaaccttttggatgatcacttagttgatgtattgttggattctgctgcatcaggttggaacacggtggagagagagggtatttcgatctcacatcctgctaggtttatcctaattggttcaggcaaccctgaagaaggggagctcaggccacaactgctggataggtttggaatgcatgctcaagtagggactgtgagggatgctgagctaagagtgaagattgtggaggagagagctcgttttgacaaaaatccgaaggttttccgggattcttacaaggcagagcaagaaaagctccagcaacaaattgcctcagcaaggagttttctttcttctgttcaaattgatcgtgatctcaaggtaaagatatccaaggtatgtgcagagttgaatgtggacggattaagaggagacatagtaacaaacagagctgcaaaagctcttgctgccctcaagggaagagacaaagtaagtgcagaggatattgctactgtcatccctaactgcttgaggcaccgtcttcgaaaggatcccttggagtcaatagattcaggtttacttgtcctagagaaattttacgaggttttcagatgaacatggtataacatgttctgtctactactcttgtatttattcaatattttaccacttcatcttttacatttttgtctttttctgtggggattttcattttccttgaaattaacatgaggaagattcagaaatcccgtgtataaacgaaaatttctggccttttgcattatacggtttcaggatc

SEQ ID NO: 243 - protein, 411 aa, Glycine max
MFGTSSIAFLSSRYHSSQSLATNSPSLTTVQVFGRKFCGGNGFHGVKVTSVVATQLNSAQQAQKIAFNESQRPVYPFSAIVGQDEMKLCLLLNVIDPKIGGVMIMGDRGTGKSTTVRSLVDLLPEIKVVAGDPYNSDPEDPEFMGVEVRERVIKGEQLQVVFSKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDKNPKVFRDSYKAEQEKLQQQIASARSFLSSVQIDRDLKVKISKVCAELNVDGLRGDIVTNRAAKALAALKGRDKVSAEDIATVIPNCLRHRLRKDPLESIDSGLLVLEKFYEVFR

SEQ ID NO: 244 - DNA, 1686 bp, Zea mays
  CDS (76)..(1350)
  misc_feature (15)..(15): n is a, g, c or t
cattgggtacctcgnagccggccgggcggctcatcccctatcccctcctcccccgctccgcaccaccacccgcccatgccccttcttcctctcctccccgtcatggcttccaccttctcccccacttccgccgcgagggccctcctcccgggctccacctcccgcccactcttcctcgccgcttcagcttcctcagggcgcattcaaccatccaggaagggactggacttccgccgcggccgattcaccgtctgcaatgtcgccgctcccaccgccgccgaacaggaggcgacggcgacggcgtcggccgcgaaggagacccagcgccccgtgtacccgttcgcggccatcgtggggcaggacgagatgaagctctgcctgctgctcaacgtcatcgaccccaagatcggcggcgtcatgatcatgggcgacaggggcacggggaagtccaccaccgtccgctccctcgtcgacctgctcccggacatccgcgtcgtcgtcggcgaccccttcaactccgacccggacgaccccgaggtcatgggccccgaggtccgccagcgggtcctgcagggggacaccggcctccccgtcaccaccgccaagatcaccatggtcgacctgcccctcggcgccaccgaggaccgcgtctgcggcaccattgacatcgagaaggcgctcaccgagggcgtcaaggcgttcgagcccggcctgctcgccaaggccaacaggggcatactgtacgtcgacgaggtcaacctgctggacgaccacctcgtcgacgtgctgctggattccgctgcgtcggggtggaacacggtggagagggagggtatctccatatcccaccctgctcgcttcatcctcatcggctctggtaacccggaggaaggggagctcaggccccagctgctggaccggttcgggatgcacgcgcaggttggtaccgtcagggacgccgagctcagggtgaagatcgtggaggagagggctcgtttcgacagggatccgaagacgttccgtgagtcgtatcatgacgagcaggagaagctccagcagcagatatcatctgcacggagtaaccttggcgctgtgcagattgaccatgacctccgtgtcaagatatccaaggtgtgctctgagttgaacgttgatggactcagaggtgacattgtgactaacagggctgccaaggcgctggctgcgttgaaaggaagggacagcgtcaccgtggaggacattgctactgtcattccaaactgcttgaggcatcggctccgcaaggatccgcttgaatccattgactcgggtttacttgtcattgagaagttttatgaagtctttagctagattgttcttgaggtaaatgttccttagtcacaatttttggcgggaaccctcttgttctgttactttcataatgttctgctgtttaataatatctggagcttgaattggtatcaaaaaaaaaaaaaaaaaaaaaaaaaaaaaaaaaaaatggcttgcgtcccggcagcgccgcaggggccgaacacgaagccggagagcgcgtggcggctgtgcacggtggccgaggtgcagcaggcaaagacgctcctcgccgtgacgcccatcttcgcgtgcaccatcgtcttcaacaccgtgctcgcgcagctgcagacgttctcggtgcagcagggcagcgcc

SEQ ID NO: 245 - protein, 424 aa, Zea mays
MPLLPLLPVMASTFSPTSAARALLPGSTSRPLFLAASASSGRIQPSRKGLDFRRGRFTVCNVAAPTAAEQEATATASAAKETQRPVYPFAAIVGQDEMKLCLLLNVIDPKIGGVMIMGDRGTGKSTTVRSLVDLLPDIRVVVGDPFNSDPDDPEVMGPEVRQRVLQGDTGLPVTTAKITMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDRDPKTFRESYHDEQEKLQQQISSARSNLGAVQIDHDLRVKISKVCSELNVDGLRGDIVTNRAAKALAALKGRDSVTVEDIATVIPNCLRHRLRKDPLESIDSGLLVIEKFYEVFS

SEQ ID NO: 246 - DNA, 1503 bp, Glycine max
  CDS (98)..(1363)
ataggaagcacgccagctgctacgaatggtgaataaaagacaaaagaaacaaactgctacatagcatacagtctgtcttctcttctcttctccggttatggcgtccgccttgggcacttcttcaattgcggttctgccttcgcgctacttctcttcttcttcttccaagccttccattcacactctctctctaacttcagggcagaactatgggcggaagttttatggaggaattggaatccatggcataaagggaagggctcagctctcggttaccaatgttgccactgaagttaactctgtagaacaggctcagagtattgcttctaaagaaagccagaggccagtatacccattttctgccatagttggacaagatgagatgaagctttgtcttctccttaatgtgattgatcctaagattggaggtgtaatgatcatgggggataggggcacagggaaatctacaacggtcaggtcattggttgatttacttcccgaaatcaaggttgttgctggtgacccttataactcagacccacaagatccagaattcatgggtgttgaagtcagagagcgtgtacttcaagaagaggaactttctgttgtcttgaccaaaattaacatggttgatttgccattgggagctacagaagatagagtgtgtggaacgattgacattgagaaagccctgactgagggtgtcaaggcatttgagcctggactactggctaaagctaataggggaatcttatatgttgatgaagttaatcttttggatgatcacttggtggatgtgttgttggattctgctgcatcaggatggaacacagtagagagagagggaatttctatctcgcctcctgcacggtttatcctaattggctcaggcaaccccgaagaaggggagctccggccgcagctgctagataggtttggaatgcatgctcaagttggaactgttagggatgctgagctcagagtgaagattgtggaggagagaggtcgatttgacaaaaatccaaaggaatttcgagattcttacaaagctgagcaagagaagctccaacaacaaattacctcagcaaggagtgttctttcttctgttcaaattgatcaagatctcaaggtgaaaatctccaaggtgtgtgctgagttgaatgtggatggattaagaggagacatagtaacaaatagagctgcaaaagctctggctgctctgaagggaagagacaacgtaagtgccgaggatattgctactgtcatccctaactgcttgagacaccgtcttagaaaggatcccttggagtctatagactcaggtttacttgtcactgagaaattttatgaggtattcagctgaggatcatagatgtaacacggtttgtattctgtggtattccatgagtataatgctacttcattatttacattttaccttttctgtggagattttcattgtcgttaaacatcaataagattcatgagttccttctacacagg

SEQ ID NO: 247 - protein, 421 aa, Glycine max
MASALGTSSIAVLPSRYFSSSSSKPSIHTLSLTSGQNYGRKFYGGIGIHGIKGRAQLSVTNVATEVNSVEQAQSIASKESQRPVYPFSAIVGQDEMKLCLLLNVIDPKIGGVMIMGDRGTGKSTTVRSLVDLLPEIKVVAGDPYNSDPQDPEFMGVEVRERVLQEEELSVVLTKINMVDLPLGATEDRVCGTIDIEKALTEGVKAFEPGLLAKANRGILYVDEVNLLDDHLVDVLLDSAASGWNTVEREGISISPPARFILIGSGNPEEGELRPQLLDRFGMHAQVGTVRDAELRVKIVEERGRFDKNPKEFRDSYKAEQEKLQQQITSARSVLSSVQIDQDLKVKISKVCAELNVDGLRGDIVTNRAAKALAALKGRDNVSAEDIATVIPNCLRHRLRKDPLESIDSGLLVTEKFYEVFS

SEQ ID NO: 248 - DNA, 1377 bp, Zea mays
  CDS (24)..(1265)
ccacgcgtccgctcctccccgtcatggcttccaccttctcccccacttccgccgcgagggccctcctcccgggctccacctcccgcccactcttcctcgccgcttcagcttcctcagggcgcattcaaccatccaggaagggactggacttccgccgcggccgattcaccgtctgcaatgtcgccgctcccaccgccgccgaacaggaggcgacggcgtcggccgcgaaggagacccagcgccccgtgtacccgttcgcggccatcgtggggcaggacgagatgaagctctgcctgctgctcaacgtcatcgaccccaagatcggcggcgtcatgatcatgggcgacaggggcacggggaagtccaccaccgtccgctccctcgtcgacctgctcccggacatccgcgtcgtcgtcggcgaccccttcaactccgacccggacgaccccgaggtcatgggccccgaggtccgccaacgggtcctgcagggggacaccggcctccccgtcaccaccgccatagtcaccatggtcgacctgcccctgggcgccaccgaggaccgcgtctgcggcaccattgacatcgagaaggcgctcaccgagggcgtcaaggcgttcgagcccggcctgctcgccaaggccaacaggggcatactgtacgtcgacgaggtcaacctgctggacgaccacctcgtcgacgtgctgctggattccgctgcgtcggggtggaacacggtggagagggagggtatctccatatcccaccttgttggctttatcttaatgggttttgttaacccggaggagggggagttcagcccccagttgttggaccggttcgggttgcaggcccaggttgttccgttcagggacccggagttcaggttgaaaatcttggaggggaggcttgttttcgacaggaatccgaagacgttccgtgagtcgtatcatgacgagcaggagaagctccagcagcagatatcatctgcacggagtaaccttggcgctgtgcagattgaccatgacctccgtgtcaagatatccaaggtgtgctctgagttgaacgttgatggactcagaggtgacattgtgactaacagggctgccaaggcgctggctgcgttgaaaggaagggacagcgtcaccgtggaggacattgctactgtcattccaaactgcttgaggcatcggctccgcaaggatccgcttgaatccattgactcgggtttacttgtcattgagaagttttatgaagtctttagctagattgttcttgaggtaaatgttcctttgtcacaatttttggcgggaaccctcttgttctgttactttcataatgttctgctgtttaataatatctggagcttgaattggtatc

SEQ ID NO: 249 - protein, 413 aa, Zea mays
MASTFSPTSAARALLPGSTSRPLFLAASASSGRIQPSRKGLDFRRGRFTVCNVAAPTAAEQEATASAAKETQRPVYPFAAIVGQDEMKLCLLLNVIDPKIGGVMIMGDRGTGKSTTVRSLVDLLPDIRVVVGDPFNSDPDDPEVMGPEVRQRVLQGDTGLPVTTAIVTMVDLPLGATEDRVCGTIDIEKALTEGVKAFEPGLLAKANRGILYVDEVNLLDDHLVDVLLDSAASGWNTVEREGISISHLVGFILMGFVNPEEGEFSPQLLDRFGLQAQVVPFRDPEFRLKILEGRLVFDRNPKTFRESYHDEQEKLQQQISSARSNLGAVQIDHDLRVKISKVCSELNVDGLRGDIVTNRAAKALAALKGRDSVTVEDIATVIPNCLRHRLRKDPLESIDSGLLVIEKFYEVFS

SEQ ID NO: 250 - DNA, 1421 bp, Zea mays
  CDS (44)..(1312): subsp. mays
atcccctatcccctcctcccccgctccttccacacaaacctccatgccccttcttcctctcctccccgtcatggcttccaccttctcccccacttccgccgcgagggccctcctcccgggctccacctcccgcccactcttcctcgccgcttcagcttcctcagggcgcattcaaccatccaggaagggactggacttccgccgcggccgattcaccgtctgcaatgtcgccgctcccaccgccgccgaacaggaggcgacggcgtcggccgcgaaggagacccagcgccccgtgtacccgttcgcggccatcgtggggcaggacgagatgaagctctgcctgctgctcaacgtcatcgaccccaagatcggcggcgtcatgatcatgggcgacaggggcacggggaagtccaccaccgtccgctccctcgtcgacctgctcccggacatccgcgtcgtcgtcggcgaccccttcaactccgacccggacgaccccgaggtcatgggccccgaggtccgccagcgggtcctgcagggggacaccggcctccccgtcaccaccgccaagatcaccatggtcgacctgcccctcggcgccaccgaggaccgcgtctgcggcaccattgacatcgagaaggcgctcaccgagggcgtcaaggcgttcgagcccggcctgctcgccaaggccaacaggggcatactgtacgtcgacgaggtcaacctgctggacgaccacctcgtcgacgtgctgctggattccgctgcgtcggggtggaacacggtggagagggagggtatctccatatcccaccctgctcgcttcatcctcatcggctctggtaacccggaggaaggggagctcaggccccagctgctggaccggttcgggatgcacgcgcaggttggtaccgtcagggacgccgagctcagggtgaagatcgtggaggagagggctcgtttcgacagggatccgaagacgttccgtgagtcgtatcatgacgagcaggagaagctccagcagcagatatcatctgcacggagtaaccttggcgctgtgcagattgaccatgacctccgtgtcaagatatccaaggtgtgctctgagttgaacgttgatggactcagaggtgacattgtgactaacagggctgccaaggcgctggctgcgttgaaaggaagggacagcgtcaccgtggaggacattgctactgtcattccaaactgcttgaggcatcggctccgcaaggatccgcttgaatccattgactcgggtttacttgtcattgagaagttttatgaagtctttagctagattgttcttgaggtaaatgttccttagtcacaatttttggcaggaaccctcttgttctgttactttcataatgttctgctgtttaataatatctggagcttgaattggt

SEQ ID NO: 251 - protein, 422 aa, Zea mays
  subsp. mays
MPLLPLLPVMASTFSPTSAARALLPGSTSRPLFLAASASSGRIQPSRKGLDFRRGRFTVCNVAAPTAAEQEATASAAKETQRPVYPFAAIVGQDEMKLCLLLNVIDPKIGGVMIMGDRGTGKSTTVRSLVDLLPDIRVVVGDPFNSDPDDPEVMGPEVRQRVLQGDTGLPVTTAKITMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDRDPKTFRESYHDEQEKLQQQISSARSNLGAVQIDHDLRVKISKVCSELNVDGLRGDIVTNRAAKALAALKGRDSVTVEDIATVIPNCLRHRLRKDPLESIDSGLLVIEKFYEVFS

SEQ ID NO: 252 - DNA, 1421 bp, Zea mays; identical to SEQ ID NO: 250
  CDS (71)..(1312): subsp. mays

SEQ ID NO: 253 - protein, 413 aa, Zea mays
  subsp. mays
MASTFSPTSAARALLPGSTSRPLFLAASASSGRIQPSRKGLDFRRGRFTVCNVAAPTAAEQEATASAAKETQRPVYPFAAIVGQDEMKLCLLLNVIDPKIGGVMIMGDRGTGKSTTVRSLVDLLPDIRVVVGDPFNSDPDDPEVMGPEVRQRVLQGDTGLPVTTAKITMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDRDPKTFRESYHDEQEKLQQQISSARSNLGAVQIDHDLRVKISKVCSELNVDGLRGDIVTNRAAKALAALKGRDSVTVEDIATVIPNCLRHRLRKDPLESIDSGLLVIEKFYEVFS

SEQ ID NO: 254 - DNA, 1248 bp, Oryza sativa
  CDS (1)..(1248): Japonica cultivar group
atggcttccgccttctcccccgccaccgccgcgcccgccgcgtcgccggccctcttctccgcctccacctcccggcctctctccctcaccgccgccgccgctgccgtctcagcccgtatcccgtcacggagagggttccgccgcggccgcttcaccgtctgcaatgtagccgccccctccgccacccagcaggaggctaaggcggcgggcgcgaaggagagccaacggccggtgtatccgttcgcggcgatcgtggggcaggacgagatgaagctgtgcctgctgctcaacgtcatcgaccctaagatcggcggtgtcatgatcatgggagaccgtggcaccggcaaatccaccaccgtccgctcgctcgtcgacctgctcccggatatccgcgtcgttgttggcgaccctttcaattccgaccctgacgatcccgaggtcatgggccctgaggtccgggaacgcgtgctggagggtgagaagcttcctgttgtcacggccaagatcaccatggtagatcttccccttggtgccactgaggatagagtctgtggcaccattgatattgagaaggcgctcaccgatggtgtcaaggcgttcgagcctggtttgcttgccaaggccaacagggggattctttatgtggatgaggtcaatttgttggatgaccatctagtagatgtgcttctggattctgctgcgtcaggatggaacaccgtggagagagagggtatctccatctcccaccctgctcggttcatcctcattgggtctggtaaccccgaggaaggggagctccggccacagctgcttgaccggtttggcatgcacgcgcaggttggtactgtcagggatgctgaactcagggtgaaaattgttgaagagagagctcggttcgacagggatccaaaggcgttccgtgagtcctacttggaggaacaagacaagctccagcagcagatttcatctgctcggagtaaccttggtgctgtgcagattgaccatgatcttcgtgttaagatttctaaagtgtgtgcagagttgaatgttgatggattaagaggggacattgtgactaacagggctgccaaggcgttggcagcactcaaaggcagggacactgtcactgtagaggacattgccactgttatccccaactgcttgaggcatcggcttcggaaggacccacttgaatcaattgactcaggattgctcgtggttgagaagttttatgaagtcttcacctaa

SEQ ID NO: 255 - protein, 415 aa, Oryza sativa
  Japonica cultivar group
MASAFSPATAAPAASPALFSASTSRPLSLTAAAAAVSARIPSRRGFRRGRFTVCNVAAPSATQQEAKAAGAKESQRPVYPFAAIVGQDEMKLCLLLNVIDPKIGGVMIMGDRGTGKSTTVRSLVDLLPDIRVVVGDPFNSDPDDPEVMGPEVRERVLEGEKLPVVTAKITMVDLPLGATEDRVCGTIDIEKALTDGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDRDPKAFRESYLEEQDKLQQQISSARSNLGAVQIDHDLRVKISKVCAELNVDGLRGDIVTNRAAKALAALKGRDTVTVEDIATVIPNCLRHRLRKDPLESIDSGLLVVEKFYEVFT

SEQ ID NO: 256 - DNA, 1266 bp, Hordeum vulgare var
  CDS (1)..(1266)
atggccatggcctccccattctccccggcgtcggcagccgccgcctcgccggccctcttcgccgtctccacctcccgccctctctccctcaccaccgccgcaaccgccgccgtctcagcccgggctccgtctaggaccaggagtgggctccgccgcggccgcttcgccgtctgcaatgtcgcggccccctccgccgccgagcaggagacgaagccggcggccgccgcgaaggagagccagcgtccggtgtacccgttcccggcgatcgtggggcaggacgagatgaagctctgcctgctgctcaacgtcatcgaccccaagatcggcggcgtcatgatcatgggcgaccgcggcaccggtaagtccaccaccgtacgctccctcgtcgacctgctcccggacatcagcgtcgtggtcggcgaccccttcaactccgacccctacgaccccgaggtcatgggccccgaggtccgcgaccgcctcctcaagggcgagagcctccccgtcaccaccaccaagatcaccatggtcgacctgcccctcggcgccaccgaggacagggtgtgcggcaccatcgacatcgataaggcgctcaccgagggtgtcaaggcgtttgagccaggcctgcttgccaaggccaacaggggcatactgtatgtggacgaggtgaacctgctcgacgaccatctggtggatgttctgctggattctgccgcgtccgggtggaacacggtggagagggagggcatctccatctcccaccctgcgcgcttcatcctcattggctccggtaacccggaggaaggcgagctccggccgcagctcctggaccggttcgggatgcacgcgcaggttggcaccgtcagggacgccgagctgagggtgaagattgtggaggagagggctcggttcgacagggacccgaaaacgttccggcagtcctacttggaggagcaagataagctccaggagcagatcacatccgctcggagcaacctcggttctgtgcagctcgaccatgatctccgggttaagatatcccaggtgtgttccgagctgaatgtggatggactcagaggagacattgtcactaacagggcctatgccaaggcgttggctgccttgaaagggaaggacgtcgtgacagtggaggacatttccactgtgattcccactgttttgaggcatcggctccgtaaagacccgctcgaatcaatcgactcgggcttgcttgtagttgagaagttctatgaagtctttggctag

SEQ ID NO: 257 - protein, 421 aa, Hordeum vulgare var
MAMASPFSPASAAAASPALFAVSTSRPLSLTTAATAAVSARAPSRTRSGLRRGRFAVCNVAAPSAAEQETKPAAAAKESQRPVYPFPAIVGQDEMKLCLLLNVIDPKIGGVMIMGDRGTGKSTTVRSLVDLLPDISVVVGDPFNSDPYDPEVMGPEVRDRLLKGESLPVTTTKITMVDLPLGATEDRVCGTIDIDKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDRDPKTFRQSYLEEQDKLQEQITSARSNLGSVQLDHDLRVKISQVCSELNVDGLRGDIVTNRAYAKALAALKGKDVVTVEDISTVIPTVLRHRLRKDPLESIDSGLLVVEKFYEVFG

SEQ ID NO: 258 - DNA, 1248 bp, Zea mays
  CDS (1)..(1248)
atggcttccaccttctcccccacttccgccgcgagggccctcctcccgggctccacctcccgcccactcttcctcgccgcttcagcttcctcagggcgcattcaaccatccaggaagggactggacttccgccgcggccgattcaccgtctgcaatgtcgccgctcccaccgccgccgaacaggaggcgacggcgacggcgtcggccgcgaaggagacccagcgccccgtgtacccattcgcggccatcgtggggcaggacgagatgaagctctgcctgctgctcaacgtcatcgaccccaagatcggcggcgtcatgatcatgggcgacaggggcacggggaagtccaccaccgtccgctccctcgtcgacctgctcccggacatccgcgtcgtcgtcggcgaccccttcaactccgacccggacgaccccgaggtcatgggccccgaggtccgccagcgggtcctgcagggggacaccggcctccccgtcaccaccgccaagatcaccatggtcgacctgcccctcggcgccaccgaggaccgcgtctgcggcaccattgacatcgagaaggcgctcaccgagggcgtcaaggcgttcgagcccggcctgctcgccaaggccaacaggggcatactgtacgtcgacgaggtcaacctgctggacgaccacctcgtcgacgtgctgctggattccgctgcgtcggggtggaacacggtggagagggagggtatctccatatcccaccctgctcgcttcatcctcatcggctctggtaacccggaggaaggggagctcaggccccagctgctggaccggttcgggatgcacgcgcaggttggtaccgtcagggacgccgagctcagggtgaagatcgtggaggagagggctcgtttcgacagggatccgaagacgttccgtgagtcgtaccatgacgagcaggagaagctccagcagcagatatcatctgcacggagtaaccttggcgctgtgcagattgaccatgacctccgtgtcaagatatccaaggtgtgctctgagttgaacgttgatggactcagaggtgacattgtgactaacagggctgccaaggcgctggctgcgttgaaaggaagggacagcgtcaccgtggaggacattgctactgtcattccaaactgcttgaggcatcggctccgcaaggatccgcttgaatccattgactcgggtttacttgtcattgagaagttttatgaagtctttagctag

SEQ ID NO: 259 - protein, 415 aa, Zea mays
MASTFSPTSAARALLPGSTSRPLFLAASASSGRIQPSRKGLDFRRGRFTVCNVAAPTAAEQEATATASAAKETQRPVYPFAAIVGQDEMKLCLLLNVIDPKIGGVMIMGDRGTGKSTTVRSLVDLLPDIRVVVGDPFNSDPDDPEVMGPEVRQRVLQGDTGLPVTTAKITMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDRDPKTFRESYHDEQEKLQQQISSARSNLGAVQIDHDLRVKISKVCSELNVDGLRGDIVTNRAAKALAALKGRDSVTVEDIATVIPNCLRHRLRKDPLESIDSGLLVIEKFYEVFS

SEQ ID NO: 260 - DNA, 1275 bp, Nicotiana tabacum
  CDS (1)..(1275)
atggcttcactactaggaacttcctcttcagcagcagctgcaatattagcttctacacccttgtcttctcgctcctgtaagcctgccgttttctccctcttcccttcttcagggcagagtcaagggaggaagttttatggagggattagagtcccagttaagaaagggaggtcccaattccatgtggcaatttcaaatgttgcgacggaaatcaaccctgctcaagaacagaaacttgctgaggagagccagagaccggtgtatccatttgcagctatagtgggacaagatgaaatgaagttatgtcttttgctgaatgtaattgatccaaagattggaggtgtgatgataatgggtgatagaggaaccgggaagtccaccacggttagatctttggtagatttacttcctgaaatcaaagttatttctggtgatccgttcaattcagatccagatgaccaagaagtaatgagtgcagaagtccgtgacaaattgaggagcggacagcagcttcctatatctcgtaccaaaatcaacatggttgatttaccgctaggtgctactgaggacagggtgtgtggcacaatcgacattgagaaagctcttactgagggtgtgaaggctttcgagcctggtcttcttgctaaagctaacagaggaatactttatgtcgatgaggttaatcttttggatgaccatttagtagatgttcttttggattctgcagcatcgggatggaacactgttgaaagagaggggatatcaatctcacatccggcccgatttatccttattggttcaggtaatcctgaagaaggagaacttaggccacaacttcttgatcgatttggaatgcatgcccaagtggggaccgtgagagatgcagagctgagagtgaagatcgttgaggaaagagctcgttttgataagaaccccaaggaattccgtgagtcatacaaggcagagcaagaaaagctccagaatcaaatcgactcagctaggaacgctctttctgctgttacaatcgatcatgatcttcgagttaaaatctctaaggtctgtgcagaactaaatgtcgatggattgagaggtgatatagtcactaacagggcagcacgagcgttggctgcactaaaaggaagagataaggtaactccggaagatatcgccactgtcattcccaactgcttaagacacaggctgaggaaggatccgttggaatctattgactcgggtgtacttgttgttgagaaattttatgaggttttcgcctaa

SEQ ID NO: 261 - protein, 424 aa, Nicotiana tabacum
MASLLGTSSSAAAAILASTPLSSRSCKPAVFSLFPSSGQSQGRKFYGGIRVPVKKGRSQFHVAISNVATEINPAQEQKLAEESQRPVYPFAAIVGQDEMKLCLLLNVIDPKIGGVMIMGDRGTGKSTTVRSLVDLLPEIKVISGDPFNSDPDDQEVMSAEVRDKLRSGQQLPISRTKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDKNPKEFRESYKAEQEKLQNQIDSARNALSAVTIDHDLRVKISKVCAELNVDGLRGDIVTNRAARALAALKGRDKVTPEDIATVIPNCLRHRLRKDPLESIDSGVLVVEKFYEVFA

SEQ ID NO: 262 - DNA, 1275 bp, Arabidopsis thaliana
  CDS (1)..(1275)
atggcgtctcttcttggaacatcttcttctgcaatctgggcttctccttcactctcttctccttcctcaaaaccttcctcctcccccatttgcttcaggccaggaaaattgtttggaagcaagttaaatgcaggaatccaaataaggccaaagaagaacaggtctcgttaccatgtttcggttatgaatgtagccactgaaatcaactctactgaacaagtagtagggaagtttgattcaaagaagagtgcgagaccggtttatccatttgcagctatagtagggcaagatgagatgaagttatgtcttttgttgaatgttattgatccaaagattggtggtgttatgattatgggagatagaggaactggaaaatctacaactgttagatcattagttgatctgttacctgagattaatgtagttgcaggtgacccgtataactcggatccgatagatcctgagtttatgggtgttgaagtaagagagagagttgagaaaggagagcaagttcctgttattgcgactaagattaatatggttgatcttcctttgggtgcaacagaagatagagtttgtggaaccatcgatatcgaaaaggctttgacagaaggtgtaaaagcctttgagcctggtttgttggctaaagctaatagagggattctttatgttgatgaagttaacctcttggatgatcatttggttgatgttcttttggattcagctgcttctggttggaatacggttgagagagaagggatttcgatttctcacccggcgaggtttatcttgatcggttcaggaaatccggaagaaggagagcttaggccacagcttcttgatcggtttggtatgcatgcacaagtagggacggttagagatgctgatttacgggtcaagattgttgaagagagagctcgtttcgatagtaacccaaaggatttccgtgacacttacaaaaccgagcaggacaagcttcaagaccagatttcaactgctagggcaaacctttcctcggttcagattgatagggaattgaaggtgaagatctctagagtttgttcagagctcaatgttgatgggttgagaggagacatagtgactaacagagcagcaaaagcacttgcagctctcaaaggaaaagatcgagtaactccagatgatgttgcaaccgttatccctaactgcttaaggcaccgtctgaggaaagatccactggaatctattgattcaggagttctagtttccgagaagttcgccgagattttcagctga

SEQ ID NO: 263 - protein, 424 aa, Arabidopsis thaliana
MASLLGTSSSAIWASPSLSSPSSKPSSSPICFRPGKLFGSKLNAGIQIRPKKNRSRYHVSVMNVATEINSTEQVVGKFDSKKSARPVYPFAAIVGQDEMKLCLLLNVIDPKIGGVMIMGDRGTGKSTTVRSLVDLLPEINVVAGDPYNSDPIDPEFMGVEVRERVEKGEQVPVIATKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDADLRVKIVEERARFDSNPKDFRDTYKTEQDKLQDQISTARANLSSVQIDRELKVKISRVCSELNVDGLRGDIVTNRAAKALAALKGKDRVTPDDVATVIPNCLRHRLRKDPLESIDSGVLVSEKFAEIFS

SEQ ID NO: 264 - DNA, 1266 bp, Glycine max
  CDS (1)..(1266)
atggcgtccgccttgggcacttcttcaattgcggttctgccttcgcgctacttctcttcttcttcttccaagccttccattcacactctctctctaacttcagggcagaactatgggcggaagttttatggaggaattggaatccatggcataaagggaagggctcagctctcggttaccaatgttgccactgaagttaactctgtagaacaggctcagagtattgcttctaaagaaagccagaggccagtatacccattttctgccatagttggacaagatgagatgaagctttgtcttctccttaatgtgattgatcctaagattggaggtgtaatgatcatgggggataggggcacagggaaatctacaacggtcaggtcattggttgatttacttcccgaaatcaaggttgttgctggtgacccttataactcagacccacaagatccagaattcatgggtgttgaagtcagagagcgtgtacttcaaggagaggaactttctgttgtcttgaccaaaattaacatggttgatttgccattgggagctacagaagatagagtgtgtggaacgattgacattgagaaagccctgactgagggtgtcaaggcatttgagcctggactactggctaaagctaataggggaatcttatatgttgatgaagttaatcttttggatgatcacttggtggatgtgttgttggattctgctgcatcaggatggaacacagtagagagagagggaatttctatctcgcatcctgcacggtttatcctaattggctcaggcaaccccgaagaaggggagctccggccgcagctgctagataggtttggaatgcatgctcaagttggaactgttagggatgctgagctcagagtgaagattgtggaggagagaggtcgatttgacaaaaatccaaaggaatttcgagattcttacaaagctgagcaagagaagctccaacaacaaattacctcagcaaggagtgttctttcttctgttcaaattgatcaagatctcaaggtgaaaatctccaaggtgtgtgctgagttgaatgtggatggattaagaggagacatagtaacaaatagagctgcaaaagctctggctgctctgaagggaagagacaacgtaagtgccgaggatattgctactgtcatccctaactgcttgagacaccgtcttagaaaggatcccttggagtctatagactcaggtttacttgtcactgagaaattttatgaggtattcagctga

SEQ ID NO: 265 - protein, 421 aa, Glycine max
MASALGTSSIAVLPSRYFSSSSSKPSIHTLSLTSGQNYGRKFYGGIGIHGIKGRAQLSVTNVATEVNSVEQAQSIASKESQRPVYPFSAIVGQDEMKLCLLLNVIDPKIGGVMIMGDRGTGKSTTVRSLVDLLPEIKVVAGDPYNSDPQDPEFMGVEVRERVLQGEELSVVLTKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERGRFDKNPKEFRDSYKAEQEKLQQQITSARSVLSSVQIDQDLKVKISKVCAELNVDGLRGDIVTNRAAKALAALKGRDNVSAEDIATVIPNCLRHRLRKDPLESIDSGLLVTEKFYEVFS

SEQ ID NO: 266 - DNA, 1281 bp, Nicotiana tabacum
  CDS (1)..(1281)
atggcttcactactaggaacttcctcttcagcagcagctgcaatattagcttctacacccttgtcttctcgctcctgtaagcctgccgttttctccctcttcccttcttcagggcagagtcaagggaggaagttttatggagggattagagtcccagttaagaaagggaggtcccaattccatgtggcaatttcaaatgttgcgacggaaatcaacctgctcaagaacagggtcagaaacttgctggaggagagccagagaccggtgtatccatttgcagctatagtgggacaagatgaaatgaagttatgtcttttgctgaatgtaattgatccaaagattggaggtgtgatgataatgggtgataggggaaccgggaagtccaccacggttagatctttggtagatttacttcctgaaatcaaagttatttctggtgatccgttcaattcagatccagatgaccaagaagtaatgagtgcagaagtccgtgacaaattgaggagcggacagcagcttcctatatctcgtacgaaaatcaacatggttgatttaccgcttggtgctactgaggacagggtgtgtggcacaatcgacattgagaaagctcttactgagggtgtgaaggctttcgagcctggtcttcttgctaaagctaacagaggaatactttacgtcgatgaggttaatcttttggacgaccatttagtagatgttcttttggattctgcagcatcgggatggaacactgttgaaagagaggggatatcaatatcacaccctgcccggtttatccttattggttcgggtaatcctgaagaaggagaacttaggccacaacttcttgatcgatttggaatgcatgcccaagtggggaccgtgagagatgcagagctgagagtgaagatagttgaggaaagagctcgttttgataagaaccccaaggaattcagggaatcatacaaggcagagcaagaaaagctccagaaccaaatcgactcagctaggaacgctctttctgctgttacaatcgatcatgatcttcgagttaaaatctctaaggtctgtgcagaactaaacgtcgatggattgagaggtgatatagtcactaacagggcagcaagagcgttggctgcactaaaaggaagagataaggtaactccggaagatatcgccactgtcattcccaactgcttaagacacaggctgaggaaggatccgttggaatctattgactcgggtgtacttgttgttgagaaattttatgaggttttcgcctaa

SEQ ID NO: 267 - protein, 426 aa, Nicotiana tabacum
MASLLGTSSSAAAAILASTPLSSRSCKPAVFSLFPSSGQSQGRKFYGGIRVPVKKGRSQFHVAISNVATEINLLKNRVRNLLEESQRPVYPFAAIVGQDEMKLCLLLNVIDPKIGGVMIMGDRGTGKSTTVRSLVDLLPEIKVISGDPFNSDPDDQEVMSAEVRDKLRSGQQLPISRTKINMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDKNPKEFRESYKAEQEKLQNQIDSARNALSAVTIDHDLRVKISKVCAELNVDGLRGDIVTNRAARALAALKGRDKVTPEDIATVIPNCLRHRLRKDPLESIDSGVLVVEKFYEVFA

SEQ ID NO: 268 - protein, 429 aa, Artificial sequence
  Description of artificial sequence: consensus sequence
  Variant (4)..(8): Xaa in position 4 to 8 is any amino acid
  Variant (10)..(19): Xaa in position 10 to 19 is any amino acid
  Variant (20)..(25): Xaa in position 20 to 25 is any or no amino acid
  Variant (27)..(27): Xaa in position 27 is any amino acid
  Variant (29)..(42): Xaa in position 29 to 42 is any amino acid
  Variant (43)..(47): Xaa in position 43 to 47 is any or no amino acid
  Variant (49)..(56): Xaa in position 49 to 56 is any amino acid
  Variant (57)..(63): Xaa in position 57 to 63 is any or no amino acid
  Variant (65)..(65): Xaa in position 65 is any amino acid
  Variant (69)..(80): Xaa in position 69 to 80 is any amino acid
  Variant (81)..(84): Xaa in position 81 to 84 is any or no amino acid
  Variant (87)..(87): Xaa in position 87 is any amino acid
  Variant (95)..(95): Xaa in position 95 is any amino acid
  Variant (142)..(142): Xaa in position 142 is any amino acid
  Variant (144)..(144): Xaa in position 144 is any amino acid
  Variant (147)..(147): Xaa in position 147 is any amino acid
  Variant (151)..(151): Xaa in position 151 is any amino acid
  Variant (156)..(156): Xaa in position 156 is any amino acid
  Variant (160)..(160): Xaa in position 160 is any amino acid
  Variant (163)..(163): Xaa in position 163 is any amino acid
  Variant (167)..(167): Xaa in position 167 is any amino acid
  Variant (170)..(171): Xaa in position 170 to 171 is any amino acid
  Variant (173)..(174): Xaa in position 173 to 174 is any amino acid
  Variant (175)..(175): Xaa in position 175 is any or no amino acid
  Variant (177)..(177): Xaa in position 177 is any amino acid
  Variant (179)..(181): Xaa in position 179 to 181 is any amino acid
  Variant (184)..(184): Xaa in position 184 is any amino acid
  Variant (311)..(311): Xaa in position 311 is any amino acid
  Variant (315)..(316): Xaa in position 315 to 316 is any amino acid
  Variant (319)..(319): Xaa in position 319 is any amino acid
  Variant (322)..(322): Xaa in position 322 is any amino acid
  Variant (325)..(326): Xaa in position 325 to 326 is any amino acid
  Variant (329)..(329): Xaa in position 329 is any amino acid
  Variant (333)..(333): Xaa in position 333 is any amino acid
  Variant (336)..(336): Xaa in position 336 is any amino acid
  Variant (341)..(341): Xaa in position 341 is any amino acid
  Variant (343)..(344): Xaa in position 343 to 344 is any amino acid
  Variant (349)..(349): Xaa in position 349 is any amino acid
  Variant (352)..(352): Xaa in position 352 is any amino acid
  Variant (360)..(360): Xaa in position 360 is any amino acid
  Variant (377)..(377): Xaa in position 377 is any amino acid
  Variant (389)..(389): Xaa in position 389 is any amino acid
  Variant (391)..(392): Xaa in position 391 to 392 is any amino acid
  Variant (419)..(419): Xaa in position 419 is any amino acid
  Variant (422)..(422): Xaa in position 422 is any amino acid
MASXXXXXSXXXXXXXXXXXXXXXXSXPXXXXXXXXXXXXXXXXXXXGXXXXXXXXXXXXXXXVXNVAXXXXXXXXXXXXXXXXKEXQRPVYPFXAIVGQDEMKLCLLLNVIDPKIGGVMIMGDRGTGKSTTVRSLVDLLPXIXVVXGDPXNSDPXDPEXMGXEVRXRVXXGXXXLXVXXXKIXMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERXRFDXXPKXFRXSYXXEQXKLQXQIXSARSXLXXVQIDXDLXVKISKVCXELNVDGLRGDIVTNRAXAKALAALKGRDXVXXEDIATVIPNCLRHRLRKDPLESIDSGXLVXEKFYEVF

SEQ ID NO: 269 - protein, 60 aa, Artificial sequence
  Description of artificial sequence: amino acid sequence pattern comprised in a variant of SEQ ID NO: 239
DHLVDVLLDSAASGWNTVEREGISISHPARFILIGSGNPEEGELRPQLLDRFGMHAQVGT

SEQ ID NO: 270 - protein, 57 aa, Artificial sequence
  Description of artificial sequence: amino acid sequence pattern comprised in a variant of SEQ ID NO: 239
  Variant (2)..(2): Xaa in position 2 is any or no amino acid
  Variant (5)..(5): Xaa in position 5 is Asn or Thr
  Variant (30)..(30): Xaa in position 30 is Asp or Glu
TXKIXMVDLPLGATEDRVCGTIDIEKALTXGVKAFEPGLLAKANRGILYVDEVNLLD

SEQ ID NO: 271 - protein, 15 aa, Artificial sequence
  Description of artificial sequence: amino acid sequence pattern comprised in a variant of SEQ ID NO: 239
  Variant (13)..(13): Xaa in position 13 is Ala or Gly
DAELRVKIVEERXRF

SEQ ID NO: 272 - protein, 20 aa, Artificial sequence
  Description of artificial sequence: amino acid sequence pattern comprised in a variant of SEQ ID NO: 239
  Variant (2)..(5): Xaa in position 2 to 5 is any amino acid
  Variant (6)..(6): Xaa in position 6 is any or no amino acid
  Variant (8)..(8): Xaa in position 8 is any amino acid
  Variant (12)..(16): Xaa in position 12 to 16 is any amino acid
  Variant (17)..(18): Xaa in position 17 to 18 is any or no amino acid
  Variant (20)..(20): Xaa in position 20 is Ala or Gln
RXXXXXVXNVAXXXXXXXEX

SEQ ID NO: 273 - DNA, 1206 bp, Arabidopsis thaliana
  CDS (1)..(1206)
atggcccttcaagctgcttctttggtctcctctgctttctctgttcgcaaagatgcgaagttgaatgcttcttcatcatctttcaaggactcgagtctttttggtgcctccattaccgaccaaatcaaatccgaacatggatcttcctcgttaagattcaagagagaacagagcttaaggaatctagcaattcgagcccaaaccgctgcgacttcaagccctacagttacaaaatccgtggacggcaagaaaacgttgaggaaaggaaatgtggtggtcactggagcctcgtctgggttaggtctagccacggctaaagctctagctgagacagggaaatggaacgtgataatggcgtgcagagacttccttaaagccgagagagctgctaaatccgtagggatgcctaaagacagctacacagtgatgcatttagacttagcctcgttggacagcgtgagacagtttgttgataatttcaggagaacagagacgcctctcgatgttttggtctgcaatgctgcggtttatttcccgacagctaaagagcctacttacagtgctgaagggtttgagcttagtgttgcgacgaaccatttgggacattttcttctcgcaaggttgttgcttgatgacttgaagaaatctgattacccttcaaagcgtctcatcatcgtcggatccattaccgggaacacgaatacattggcgggtaatgtaccaccgaaggcgaatctcggtgatttgaggggtttagccggcggattaaacggtttaaacagctcagctatgattgatggaggagatttcgacggtgcaaaggcttacaaagacagtaaagtctgcaatatgttgacaatgcaagagtttcacaggcgtttccatgaagaaactggagtcactttcgcttcgctttaccccggttgcatcgcctccacaggtttattccgagagcacattcctctcttccgtgccctcttccctccctttcagaagtacatcactaaaggatatgtctccgaaacagagtcaggcaaaagacttgctcaggtggtgagtgatccaagcttgacgaaatcaggggtttattggagctggaacaatgcttcggcttcttttgagaaccagttatcagaagaagcaagtgacgttgagaaggctcgtaaagtgtgggagatcagtgagaagctcgtgggcttggcctaa

SEQ ID NO: 274 - protein, 401 aa, Arabidopsis thaliana
MALQAASLVSSAFSVRKDAKLNASSSSFKDSSLFGASITDQIKSEHGSSSLRFKREQSLRNLAIRAQTAATSSPTVTKSVDGKKTLRKGNVVVTGASSGLGLATAKALAETGKWNVIMACRDFLKAERAAKSVGMPKDSYTVMHLDLASLDSVRQFVDNFRRTETPLDVLVCNAAVYFPTAKEPTYSAEGFELSVATNHLGHFLLARLLLDDLKKSDYPSKRLIIVGSITGNTNTLAGNVPPKANLGDLRGLAGGLNGLNSSAMIDGGDFDGAKAYKDSKVCNMLTMQEFHRRFHEETGVTFASLYPGCIASTGLFREHIPLFRALFPPFQKYITKGYVSETESGKRLAQVVSDPSLTKSGVYWSWNNASASFENQLSEEASDVEKARKVWEISEKLVGLA

SEQ ID NO: 275 - DNA, 1560 bp, Glycine max
  CDS (122)..(1321)
tccgacacatttttcattaccgccgtgataacacactaacaccaccacttcatcaactttacttgacaacaatattgtaaaactcaaaatctagtttcatactttttttcttcttcttgaaatggctctccaggctgcttctcttgttcctgcttctttctcggttcttaaagagggaaagagtggtgtgtctctcaaggactccaccttgttcggtctttcattttcagaacctatcaaagctaacttcagctcttctgcattgaggtgcaagagggaattcgaacaaaagctctgtgctgtgagggccgaaacagtggctacagcctctccagcagttaccaagtctacaccagaagggaagaaaacattgaggaagggcagtgttgtgataactggggcttcatctggactaggcctggccactgctaaggctttggctgagacgggaaaatggcatgtaataatggcctgcagggattacctcaaagctgcaagagctgcaaaatccgctggcatggctaaggaaaactacaccatcatgcacttggaccttgcctcgctcgacagtgtccgccaatttgttgataacttcagaagatcggaaatgccgttagatgtgctggtttgcaatgctgctgtttacttgccaactgctaaggaacctaccttcactgctgagggctttgaacttagtgttgggacaaatcatctggggcatttcctcctctcgcgcctgttgcttgaggacttggaaaaatccgattacccttcaaagcgcttgatcatcgttggttcaataacagggaacacaaacacattggctggtaatgtacctcccaaggctaaccttggtgacttgaggggacttcagggtggtttgaatgggctaaacagctcagccatgattgatggtggagacttcgatggtgccaaggcgtacaaggacagcaaagtctgcaatatgctcacaatgcaagaattccacagacgattccatgaggaaactggaatcacatttgcttccctttaccccggttgcattgccacaacaggcctgttcagagagcacattcccttgttcagaactctgttccctccattccagaagtacataaccaaaggctatgtctcagaagatgaagcaggaaagagacttgctcaggttgtaagtgatccaagcctaacaaaatctggtgtttactggagctggaacaaagcatcagcttcgtttgaaaaccagttgtctcaggaggccagtgatacagagaaggctcgtaagatctgggagattagtgagaaacttgttggttttgcctaagtgggaggagcctccaacatcccatgttgttctagagaccttgcacttgcatggaggaagaaaatgatgtctcaaaagagtggatagataacatcctatcattttgaatgcattgatgttgttttgttagctaggagcttctttgctttgatgtaaggtgtcaatggctttttgtgaatcaagactcaataaaatcattcagccatgtgggtgtggtgaagttgctcataaactttctg

SEQ ID NO: 276 - protein, 399 aa, Glycine max
MALQAASLVPASFSVLKEGKSGVSLKDSTLFGLSFSEPIKANFSSSALRCKREFEQKLCAVRAETVATASPAVTKSTPEGKKTLRKGSVVITGASSGLGLATAKALAETGKWHVIMACRDYLKAARAAKSAGMAKENYTIMHLDLASLDSVRQFVDNFRRSEMPLDVLVCNAAVYLPTAKEPTFTAEGFELSVGTNHLGHFLLSRLLLEDLEKSDYPSKRLIIVGSITGNTNTLAGNVPPKANLGDLRGLQGGLNGLNSSAMIDGGDFDGAKAYKDSKVCNMLTMQEFHRRFHEETGITFASLYPGCIATTGLFREHIPLFRTLFPPFQKYITKGYVSEDEAGKRLAQVVSDPSLTKSGVYWSWNKASASFENQLSQEASDTEKARKIWEISEKLVGFA

SEQ ID NO: 277 - DNA, 1577 bp, Glycine max
  CDS (69)..(1268)
cccacgcgtccggaaacattctaaaacaaaggacccagttttacatttttttttgttcctgagttccaatggctcttcaggctgcttccttggtttctgcttctttttctattgctaaagagggaaagtctggtgtatctctcagggacaccacaatgtttggtgtttcattgtcggatactctcaaatctgacttcagctctccctcatcgacttgcaaaagggaattccaacaaaaatttggccctttgagggttcagtcagtggcaacaacaactccaggagtcaccaaggcttcaccagaaggcaagaaaactttgaggaaaggcagtgttattatcactggggcttcctctggattaggcctggccactgctaaggctttggctgagacaggaaagtggcatgtgataatggcctgccgggatttcctcaaagccgaaagggctgcgaaatctgccggcattgctaaggaaaactacactattatgcatttggaccttgcatctcttgatagtgtgaggcaatttgttgataactttaggcaatcaggccggccactggatgtgcttgtttgcaatgctgcggtttacttgccaactgccagggaacctacatatactgctgatggctttgaactcagtgttggaaccaaccatctcgggcatttcctcctttcgcgccttttgcttgacgacttgaacaaatctgactacccttcgaagcggttgatcattgtaggctcaatcacaggaaacaccaacacattggctggaaatgtgccacccaaggctaaccttggtgacatgaggggactagctggaggcttgaatgggctaaacacttcagccatgatagatggaggatcctttgacggcgctaaggcatacaaggacagcaaagtctgcaacatgcttacaatgcaagaattccacagaagataccatgatgaaactgggatcacatttgcttccctttacccaggttgcatcgccacaacaggcttgttcagagagcacattcccttgttcagacttctcttccctccattccaaaagtacataaccaagggctttgtctcagaagatgaatcaggaaagagacttgcacaggttgtgagtgatccaagcctaacaaaatcaggtgtttactggagctggaacgcggcctctgcttcgtttgaaaaccaattgtcccaagaagccagcgatgcagataaggctcgcaaggtttgggagattagtgagaaacttactggtttggcttaagtggtactttggcagcttccaatatccatcttgatttagggacatttgtcatggagttcaataacatctcagaagagtttagaccctcttctgatgagtttgttagattctttttctagctgctaactcctcttggtctgataactactgtcgatgaatccttcacctgaggccaagtgcacatgaactatagagaaataataattgtgcacatgaactatagagaaataataattgtgcacattgactatgatcaatgccattgcctatcttatgttaatagtcatttatgtgaactccagagtgaat

SEQ ID NO: 278 - protein, 399 aa, Glycine max
MALQAASLVSASFSIAKEGKSGVSLRDTTMFGVSLSDTLKSDFSSPSSTCKREFQQKFGPLRVQSVATTTPGVTKASPEGKKTLRKGSVIITGASSGLGLATAKALAETGKWHVIMACRDFLKAERAAKSAGIAKENYTIMHLDLASLDSVRQFVDNFRQSGRPLDVLVCNAAVYLPTAREPTYTADGFELSVGTNHLGHFLLSRLLLDDLNKSDYPSKRLIIVGSITGNTNTLAGNVPPKANLGDMRGLAGGLNGLNTSAMIDGGSFDGAKAYKDSKVCNMLTMQEFHRRYHDETGITFASLYPGCIATTGLFREHIPLFRLLFPPFQKYITKGFVSEDESGKRLAQVVSDPSLTKSGVYWSWNAASASFENQLSQEASDADKARKVWEISEKLTGLA

SEQ ID NO: 279 - DNA, 1476 bp, Zea mays
  CDS (103)..(1266)
cccacgcgtccgcggacgcgtgggttcggcacgaacaaaagcgcatcgatctcgctgtcgtcactcctcgtcacccagccacgaacagaggcaccacccagcatggccctgcaggcggcgctcctcccatccaccctctcatccgtccccaagaagtgcagcctcgccgtcgcggcgaaggacacggcattccttagcgtatcccagaagaaggtgcaggcggcgtcgctgtcggtgagaacgcgggtggcgacgacggcgcctgtggccacgccggggtccagcacggcggccaaggatgggaagaagaccgtgcggcagggcgtggtggtgatcacgggcgcgtcgtcggggttgggcctggcggcggccaaggcgctggcggagaccggcaagtggcacgtggtgatggcctgccgcgacttcctcaaggcggccaaggcggccaagggcgccggcatggcggacggcagctacaccatcatgcacctggacctggcctccctcgacagcgtgcggcagttcgtggacagcttccggcgcgccggcatgccgctcgactcgctcgtctgcaacgccgccatctaccggcccacggcgcggacgccgacgttcacggcggacgggtacgagatgagcgtcggcgtcaaccacctgggccacttcctcctggcgcgcctgctcctggacgacatgcagaagtccgactacccgtcccgccgcctcgtcatcctcggctccatcaccggcaacaccaacacgctggccgggaacatcccgcccaaggccgggctgggcgacctccgcggcctcgcggcggggctgcgcggccagaacggctctgccatgatcgacggctccgagagcttcgacggcgccaaggcgtacaaggacagcaagatctgcaacatgctcaccatgcaggagctgcaccggcggtaccacgaggagacgggcatcacgttcgcgtcgctctacccggggtgcatcgccaccacggggctgttccgcgagcacatcccgctgttccgcctgctcttcccgccgttccagaagttcgtcaccaagggcttcgtgtcggaggcggagtccggcaagaggctggcgcaggtggtcagcgaccccagcctcaccaagtcgggggtgtactggagctggaacaaggactcggcgtcgttcgagaaccagctgtcgcaggaggccagcgatccggagaaggccaagaagctctgggagatcagcgagaagctcgtggggcttgcctgagctcgccggcacggcgacggcgacatgatgactctgtcgagcagaggagctttcgcttcgttgtattatgtgtaccattagcatccattttgtttgtttctagaagttggtaatgaccgtcggagaagagcctgtaattgttcgatcatgtattattgcttacaaaatttttttcaaaaaccgatgaaataaaacaacaggcttaacatc

SEQ ID NO: 280 - protein, 387 aa, Zea mays
MALQAALLPSTLSSVPKKCSLAVAAKDTAFLSVSQKKVQAASLSVRTRVATTAPVATPGSSTAAKDGKKTVRQGVVVITGASSGLGLAAAKALAETGKWHVVMACRDFLKAAKAAKGAGMADGSYTIMHLDLASLDSVRQFVDSFRRAGMPLDSLVCNAAIYRPTARTPTFTADGYEMSVGVNHLGHFLLARLLLDDMQKSDYPSRRLVILGSITGNTNTLAGNIPPKAGLGDLRGLAAGLRGQNGSAMIDGSESFDGAKAYKDSKICNMLTMQELHRRYHEETGITFASLYPGCIATTGLFREHIPLFRLLFPPFQKFVTKGFVSEAESGKRLAQVVSDPSLTKSGVYWSWNKDSASFENQLSQEASDPEKAKKLWEISEKLVGLA

SEQ ID NO: 281 - DNA, 1545 bp, Zea mays
  CDS (116)..(1279)
cccacgcgtccgcccacgcgtccgcggacgcgtgggcttcgccacgaacaaaagcgcatcgatctcgctgtcgtcactcctcgtcacccagccacgaacagaggcaccacccagcatggccctgcaggcggcgctcctcccatccaccctctcatccgtccccaagaagtgcagcctcgccgtcgcggcgaaggacacggcattccttagcgtatcccagaagaaggtgcaggcggcgtcgctgtcggtgagaacgcgggtggcgacgacggcgcctgtggccacgccggggtccagcacggcggccaaggatgggaagaagaccgtgcggcagggcgtggtggtgatcacgggcgcgtcgtcggggttgggcctggcggcggccaaggcgctggcggagaccggcaagtggcacgtggtgatggcctgccgcgacttcctcaaggcggccaaggcggccaagggcgccggcatggcggacggcagctacaccatcatgcacctggacctggcctccctcgacagcgtgcggcagttcgtggacagcttccggcgcgccggcatgccgctcgactcgctcgtctgcaacgccgccatctaccggcccacggcaaggacgccgacgttcacggcggacggatacgagatgagcgtcggcgtcaaccacctgggccacttcctcctggcgcgcctgctcctggacgacatgcagaagtccgactacccgtcccgccgcctcatcatcctcggctccatcaccggcaacaccaacacgctggccgggaacatcccgcccaaggccgggctgggcgacctccgcggcctcgcggcggggctgcgcggccagaacggctctgccatgatcgacggctccgagagcttcgacggcgccaaggcgtacaaggacagcaagatctgcaacatgctaacaatgcaggagctgcaccggcggtaccacgaggagacgggcatcacgttcgcgtcgctctacccggggtgcatcgccaccacggggctgttccgcgagcacatcccgctgttccggctgctcttcccgccgttccagaagttcgtcaccaagggcttcgtgtcggaggcggagtccggcaagaggctggcgcaggtggtcagcgaccccagcctcaccaagtcgggggtgtactggagctggaacaaggactcggcgtcgttcgagaaccagctgtcgcaggaggccagcgatccggagaaggccaagaagctctgggagatcagcgagaagctcgtggggcttgcctgagctcgccggcacggcgacagcgacatgatgaatctgtcgagcaaaggagctttcgcttcgttgtattatgtgtaccattagcatccattttgtttgtttctagaagttggtaatgaccgtcggagaagagcctgtaattgttcgatcatgtattgcttacaatttttttttaaaccgatgaaataaaacaatcaggcttaaccccccccaaaaaaaaaaaaaaaaaaaaaaaaaaaaaaaaaaaaaaaaaccccccccccccgcgc

SEQ ID NO: 282 - protein, 387 aa, Zea mays
MALQAALLPSTLSSVPKKCSLAVAAKDTAFLSVSQKKVQAASLSVRTRVATTAPVATPGSSTAAKDGKKTVRQGVVVITGASSGLGLAAAKALAETGKWHVVMACRDFLKAAKAAKGAGMADGSYTIMHLDLASLDSVRQFVDSFRRAGMPLDSLVCNAAIYRPTARTPTFTADGYEMSVGVNHLGHFLLARLLLDDMQKSDYPSRRLIILGSITGNTNTLAGNIPPKAGLGDLRGLAAGLRGQNGSAMIDGSESFDGAKAYKDSKICNMLTMQELHRRYHEETGITFASLYPGCIATTGLFREHIPLFRLLFPPFQKFVTKGFVSEAESGKRLAQVVSDPSLTKSGVYWSWNKDSASFENQLSQEASDPEKAKKLWEISEKLVGLA

SEQ ID NO: 283 - DNA, 1545 bp, Zea mays
  CDS (146)..(1243)
cattgggtacctcgaggccggccgggatccccccgtggagaggagaggaagaagaagaacccagccaaatcctcagtcttcaggctgctcacagctcgtgccgtccactctcccccgaggcagtctcttgcgttcgctgctcgacatggcgctccaggcggcgacgtcctttctcccctcggccctctccgcgcgcaaggagagggtgagcaggtcggcggacatccgcgcgcagacggcagcggtgtcctccccgtcagtgacccccgcgtcgccgtctggcaagaagaccctccgcaagggcacggcggtcatcaccggcgcgtcgtccggcctcggcctcgccacggcgaaggccctcgcggagacaggcaagtggcacgtcatcatggcctgccgcgacttcctcaaggcgtcgcgcgcggccaaggcggccggcatggacaaggacagcttcaccgtcgtgcacctggacctcgcctccctggacagcgtccgccagttcgtcaggaacgtgcgccagctggagatgcccatcgacgtggtggtctgcaacgccgccgtgtaccagcccaccgccaaggagccgtcctacaccgccgacggcttcgagatgagcgtcggcgtcaaccacctcggccatttcctcctcgcccgcgagctcctcagcgacctccagtcctccgactacccctctaagcgcctcatcatcgtcggctccatcaccgggaacacgaacacgctggcggggaacgtgcccccgaaggcgaacctgggcgacctgcgcggcctcgccggcggcctcaacggcgttggcagctcggtgatgatcgacggcggggagttcgacggcgccaaggcatacaaggacagcaaggtgtgcaacatgctgacgatgcaggagttccaccgccggtaccacgaggagacgggcgtgaccttcgcgtcgctctacccgggctgcatcgccaccacgggcctgttccgcgagcacatcccgctgttccgcctgctcttcccgccgttccagaagtacatcaccaaggggtacgtctccgaggaggaggccgggaagcggctggcgcaggtggtgagcgaccccagcctgaccaagtccggcgtgtactggagctggaacaagaactccgcgtccttcgagaaccagctctctgaggaggccagcgacgccgacaaggccaagaagctctgggagatcagcgagaagctcgtcggcttggcgtgatgcccaccgtggccggcgccggcagccggcgacagtttttcctacctaggacatgctcattagttggtctcactctcagtcgagtagtcgacgtgtggtgcgcccgtgtcagagtgccaagccaagacagaaagtgagtacaaacgtgtaaaatatgtgctactgcgacgtgatggtttgggcagtggactgtatgtatctctactctctaggcttctgctttgctttgcatatttaattttctgctaataagaggacagcaaatgcctttcgagcggaaaaaaaaaaaaaaaaaagcggcc

SEQ ID NO: 284 - protein, 365 aa, Zea mays
MALQAATSFLPSALSARKERVSRSADIRAQTAAVSSPSVTPASPSGKKTLRKGTAVITGASSGLGLATAKALAETGKWHVIMACRDFLKASRAAKAAGMDKDSFTVVHLDLASLDSVRQFVRNVRQLEMPIDVVVCNAAVYQPTAKEPSYTADGFEMSVGVNHLGHFLLARELLSDLQSSDYPSKRLIIVGSITGNTNTLAGNVPPKANLGDLRGLAGGLNGVGSSVMIDGGEFDGAKAYKDSKVCNMLTMQEFHRRYHEETGVTFASLYPGCIATTGLFREHIPLFRLLFPPFQKYITKGYVSEEEAGKRLAQVVSDPSLTKSGVYWSWNKNSASFENQLSEEASDADKAKKLWEISEKLVGLA

SEQ ID NO: 285 - DNA, 1513 bp, Zea mays
  CDS (120)..(1310): subsp. mays
accccacccccacgcgaagaggaagaggaagaacccagccaaatcctcagtcctcaggctgctcacagttcgtgctatccgctcgcgctcccggtagtctgcctgctcggcaattcggcatggcgctccaggccgcgacgtccttcctcccctcggccctctcggcgcgcaaggaggggtcgtcggtgaaggactcggcgttcttgggtgtccatctcgcggacgatggcctcaagctggagaccgctgctctgggcctacgcaccaagagggtgatcacgtcggtggccatccgcgcgcaggcggcagcggtgtcctcaccatcagtaacccccgcgtcgccgtccggcaagaagacgctccgcaagggcacggcgatcataaccggcgcgtcgtccggtctcggcctggccacggcgaaggccctggcggagaccggcaagtggcacgtcatcatggcctgccgcgattttctcaaggcgtcgcgcgcggccaaagcggccggcatggacaaggacagcttcaccgtcgtgcacctggacctcgcctccctcgacagcgtccgccagttcgtcaagaacgtgcgccagctggagatgcccgtcgacgtggtggtctgcaacgccgccgtgtaccagcccaccgccaaggagccgtcctacaccgccgacggcttcgagatgagcgtcggcgtcaaccacctcggccacttcctcctcgcccgcgagctcctcagcgacctccagtcctccgactatccctccaagcgcctcatcatcgtcggctccatcaccgggaacacgaacacgctggcggggaacgtgccgccgaaggcgaacctgggtgacctgcgcggcctcgccggcggcctcaacggcattggcggctccgcgatgatcgacggcggggagttcgacggggccaaggcatacaaggacagcaaggtgtgcaacatgctgacgatgcaggagttccaccgccggtaccacgaggagacgggcgtgaccttcgcgtcgctctaccccggctgcatcgccaccacgggcctgttccgcgagcacatcccgctgttccgcctgctcttcccgccattccagaagtacatcaccaaggggtacgtctccgaggaggaggccgggaagcggctgtcgcaggtcgtgagcgaccccagcctgaccaagtccggcgtgtactggagctggaacaagaactcggcgtccttcgagaaccagctctctgaggaggccagcgacgccgacaaggccaagaagctctgggagatcagcgagaagctcgtcggcttggcgtgacgacctgatgcccaccgtggccggcgccggcagccggtgacagttttttcctaggacatgttcgttacttgatctcagtcgacgcgtggtgcactcgtgtcagagtgacaggagaggaagtgtgtacactgtacacgtgtaggcatgtttggttgacttttttgttacgaggttttctgataatatagctgtggagagaatct

SEQ ID NO: 286 - protein, 396 aa, Zea mays
  subsp. mays
MALQAATSFLPSALSARKEGSSVKDSAFLGVHLADDGLKLETAALGLRTKRVITSVAIRAQAAAVSSPSVTPASPSGKKTLRKGTAIITGASSGLGLATAKALAETGKWHVIMACRDFLKASRAAKAAGMDKDSFTVVHLDLASLDSVRQFVKNVRQLEMPVDVVVCNAAVYQPTAKEPSYTADGFEMSVGVNHLGHFLLARELLSDLQSSDYPSKRLIIVGSITGNTNTLAGNVPPKANLGDLRGLAGGLNGIGGSAMIDGGEFDGAKAYKDSKVCNMLTMQEFHRRYHEETGVTFASLYPGCIATTGLFREHIPLFRLLFPPFQKYITKGYVSEEEAGKRLSQVVSDPSLTKSGVYWSWNKNSASFENQLSEEASDADKAKKLWEISEKLVGLA

SEQ ID NO: 287 - DNA, 1200 bp, Arabidopsis thaliana
  CDS (1)..(1200)
atggctctccaagctgcctattctcttcttccttctaccatttcaatccaaaaagagggcaaattcaatgcttctctaaaggagacgacttttactggttcttcattttcaaaccatcttagagctgaaaagatatccaccctgttgaccatcaagagaagacagaaaccgcgattttccaccggtattcgtgcacagacagttacagccacgccgccggcaaacgaagcatcgccggagcaaaagaagactgagagaaaaggcactgcagtgatcactggagcttcgtctggtttaggtttagctacggccaaagctttagcagacacagggaaatggcatgtgatcatggcttgcaggaactttctcaaggccgagaaggcagcgagatctgttggaatgtccaaggaagattacacagtgatgcatcttgatcttgcttcgcttgaaagcgtgaagcaattcgttgaaaatttccggagaacagaacaaccactcgatgttcttgtctgcaatgccgcggtttaccaaccaactgctaaagagccttcttttacagctgaaggctttgagataagcgttggaaccaaccatctcggtcactttcttctctcaagattgcttcttgatgacctgaaaaaatctgattatccatcaaaacgtatgatcatcgtaggatctataacaggaaacacaaatactttggctgggaatgtaccgccaaaggcaaaccttggagacctaagaggcttagcgtcaggattgaatgggcaaaacagttcaatgatagatggaggagagtttgatggagcaaaggcttacaaagacagcaaagtatgcaatatgctgacaatgcaggagcttcacagacgttaccacgaggaaacaggagtcacgtttgcttctctttaccctggttgcatcgctacaacagggttgttcagagaacacataccgctgtttcggcttctttttccgccttttcaaaagtatatcaccaaaggttacgtatctgaagaggaagctggcaaaagactagcacaggttgtgagtgaccctagtcttgggaagtcaggagtgtattggagttggaacaataactcgtcttcgtttgagaatcagctttctaaagaagcaagtgatgcggagaaggcaaagaaactgtgggaggttagcgagaagcttgttggtttggcatga

SEQ ID NO: 288 - protein, 399 aa, Arabidopsis thaliana
MALQAAYSLLPSTISIQKEGKFNASLKETTFTGSSFSNHLRAEKISTLLTIKRRQKPRFSTGIRAQTVTATPPANEASPEQKKTERKGTAVITGASSGLGLATAKALADTGKWHVIMACRNFLKAEKAARSVGMSKEDYTVMHLDLASLESVKQFVENFRRTEQPLDVLVCNAAVYQPTAKEPSFTAEGFEISVGTNHLGHFLLSRLLLDDLKKSDYPSKRMIIVGSITGNTNTLAGNVPPKANLGDLRGLASGLNGQNSSMIDGGEFDGAKAYKDSKVCNMLTMQELHRRYHEETGVTFASLYPGCIATTGLFREHIPLFRLLFPPFQKYITKGYVSEEEAGKRLAQVVSDPSLGKSGVYWSWNNNSSSFENQLSKEASDAEKAKKLWEVSEKLVGLA

SEQ ID NO: 289 - DNA, 1209 bp, Oryza sativa
  CDS (1)..(1209): Japonica cultivar group
atggctctccaggcggccaccaccacctccttcctcccctccgcgctctccgcccgcaaggagggagcggtgaaggactcggcgttcttgggcgttcgtctcggcgacgggctcaagctggagaccagtgctctcggccttcgcaccaagagggtgagcacgtcgtcggtggccatccgcgcgcaggcgtcggcggcggtgtcgtccccgacggtgacgccggcgtcgccgtcgggcaagcagacgctgcgcaagggcacggcggtcatcaccggcgcgtcgtccgggcttggcctcgcgacggcgaaggcgctggcggagacgggcaggtggcacgtcgtcatggggtgccgcgacttcctcaaggcgtcgcgcgccgccaaggccgccggcatggagaagggcagctacaccatcgtccacctcgacctggcgtcgctcgacagcgtcaggcagttcgtcgccaacgtccggcggctggagatgcccgtcgacgtggtggtgtgcaacgccgccgtgtaccagcccaccgccaagcagccgagcttcaccgccgacggcttcgagatgagcgtcggcgtcaaccacctcgggcacttcctcctcgcccgcgagctcctcgccgacctcacctcctccgactacccctccaagcgcctcatcatcgtcggctccatcaccgggaacacgaacacgctggcggggaacgtgccgccgaaggcgaacctgggggacctccgggggctcgcctcgggcctcgacggcgtgtcgagctccgccatgatcgacggcggcgagttcgacggcgccaaggcctacaaggacagcaaggtgtgcaacatgctgacgatgcaggagttccaccgccggtaccacggcgagaccggggtgacgttcgcgtcgctctaccccgggtgcatcgccaccacgggcctcttccgggagcacgtcccgctgttccgcctcctcttcccgcccttccagaagtacatcaccaagggctacgtctccgaggaggaggccggcaagcggctggcccaggtcgtcagtgaccccagcctcaccaagtccggggtgtactggagctggaacaacaactcggcctcgttcgagaaccagctctccgaggaggcctccgatccggagaaggccaagaaggtctgggagctcagcgagaagctcgtcggcttggccgatcacgatcagtga

SEQ ID NO: 290 - protein, 402 aa, Oryza sativa
  Japonica cultivar group
MALQAATTTSFLPSALSARKEGAVKDSAFLGVRLGDGLKLETSALGLRTKRVSTSSVAIRAQASAAVSSPTVTPASPSGKQTLRKGTAVITGASSGLGLATAKALAETGRWHVVMGCRDFLKASRAAKAAGMEKGSYTIVHLDLASLDSVRQFVANVRRLEMPVDVVVCNAAVYQPTAKQPSFTADGFEMSVGVNHLGHFLLARELLADLTSSDYPSKRLIIVGSITGNTNTLAGNVPPKANLGDLRGLASGLDGVSSSAMIDGGEFDGAKAYKDSKVCNMLTMQEFHRRYHGETGVTFASLYPGCIATTGLFREHVPLFRLLFPPFQKYITKGYVSEEEAGKRLAQVVSDPSLTKSGVYWSWNNNSASFENQLSEEASDPEKAKKVWELSEKLVGLADHDQ

SEQ ID NO: 291 - DNA, 1164 bp, Oryza sativa
  CDS (1)..(1164): Japonica cultivar group
atggctctccaagttcaggccgcactcctgccctctgctctctctgtccccaagaagggtaacttgagcgcggtggtgaaggagccggggttccttagcgtgagccagaaggccaagaagccgtcgctggtggtgagggcggtggcgacgccggcggcgccggtggcgagccccggcgcgggcacgtcgaaggcggacgggaagaagacgctgcggcagggggtggtggtgatcaccggcgcgtcgtcggggctcgggctcgcggcggcgaaggcgctggcggagacggggaagtggcacgtggtgatggcgtgccgcgacttcctgaaggcggcgacggcggcgaaggcggcggggatggcggcggggagctacaccgtcatgcacctggacctcgcctccctcgacagcgtccgccagttcgtggacaacttccggcgctccggcatgccgctcgacgcgctggtgtgcaacgccgccatctaccggccgacggcgcggcagccgacgttcaccgccgacgggtacgagatgagcgtcggggtgaaccacctgggccacttcctcctcgcccgcctcatgctcgacgacctcaagaaatccgactacccgtcgcggcggctcatcatcctcggctccatcaccggcaacaccaacaccctcgccggcaacgtccctcccaaggccgggctaggcgacctccgggggctcgccggcgggctccgcgggcagaacgggtcggcgatgatcgacggcgcggagagcttcgacggcgccaaggcgtacaaggacagcaagatctgtaacatgctgacgatgcaggagttccaccggagattccacgaggagaccgggatcacgttcgcgtcgctgtacccggggtgcatcgcgacgacgggcttgttccgcgagcacatcccgctgttccggctgctgttcccgccgttccagcggttcgtgacgaaggggttcgtgtcggaggcggagtccgggaagcggctggcgcaggtggtgggcgacccgagcctgaccaagtccggcgtgtactggagctggaacaaggactcggcgtcgttcgagaaccagctctcgcaggaggccagcgacccggagaaggccaggaagctctgggacctcagcgagaagctcgtcggcctcgtctga

SEQ ID NO: 292 - protein, 387 aa, Oryza sativa
  Japonica cultivar group
MALQVQAALLPSALSVPKKGNLSAVVKEPGFLSVSQKAKKPSLVVRAVATPAAPVASPGAGTSKADGKKTLRQGVVVITGASSGLGLAAAKALAETGKWHVVMACRDFLKAATAAKAAGMAAGSYTVMHLDLASLDSVRQFVDNFRRSGMPLDALVCNAAIYRPTARQPTFTADGYEMSVGVNHLGHFLLARLMLDDLKKSDYPSRRLIILGSITGNTNTLAGNVPPKAGLGDLRGLAGGLRGQNGSAMIDGAESFDGAKAYKDSKICNMLTMQEFHRRFHEETGITFASLYPGCIATTGLFREHIPLFRLLFPPFQRFVTKGFVSEAESGKRLAQVVGDPSLTKSGVYWSWNKDSASFENQLSQEASDPEKARKLWDLSEKLVGLV

SEQ ID NO: 293 - DNA, 1164 bp, Oryza sativa
  CDS (1)..(1164)
atggctctccaagttcaggccgcactcctgccctctgctctctctgtccccaagaagggtaacttgagcgcggtggtgaaggagccggggttccttagcgtgagccagaaggccaagaagccgtcgctggtggtgagggcggtggcgacgccggcggcgccggtggcgagccccggcgcgggcacgtcgaaggcggacgggaagaagacgctgcggcagggggtggtggtgatcaccggcgcgtcgtcggggctcgggctcgcggcggcgaaggcgctggcggagacggggaagtggcacgtggtgatggcgtgccgcgacttcctgaaggcggcgacggcggcgaaggcggcggggatggcggcggggagctacaccgtcatgcacctggacctcgcctccctcgacagcgtccgccagttcgtggacaacttccggcgctccggcatgccgctcgacgcgctggtgtgcaacgccgccatctaccggccgacggcgcggcagccgacgttcaccgccgacgggtacgagatgagcgtcggggtgaaccacctgggccacttcctcctcgcccgcctcatgctcgacgacctcaagaaatccgactacccgtcgcggcggctcatcatcctcggctccatcaccggcaacaccaacaccctcgccggcaacgtccctcccaaggccgggctaggcgacctccgggggctcgccggcgggctccgcgggcagaacgggtcggcgatgatcgacggcgcggagagcttcgacggcgccaaggcgtacaaggacagcaagatctgtaacatgctgacgatgcaggagttccaccggagattccacgaggagaccgggatcacgttcgcgtcgctgtacccggggtgcatcgcgacgacgggcttgttccgcgagcacatcccgctgttccggctgctgttcccgccgttccagcggttcgtgacgaaggggttcgtgtcggaggcggagtccgggaagcggctggcgcaggtggtgggcgacccgagcctgaccaagtccggcgtgtactggagctggaacaaggactcggcgtcgttcgagaaccagctctcgcaggaggccagcgacccggagaaggccaggaagctctgggacctcagcgagaagctcgtcggcctcgcctga

SEQ ID NO: 294 - protein, 387 aa, Oryza sativa
MALQVQAALLPSALSVPKKGNLSAVVKEPGFLSVSQKAKKPSLVVRAVATPAAPVASPGAGTSKADGKKTLRQGVVVITGASSGLGLAAAKALAETGKWHVVMACRDFLKAATAAKAAGMAAGSYTVMHLDLASLDSVRQFVDNFRRSGMPLDALVCNAAIYRPTARQPTFTADGYEMSVGVNHLGHFLLARLMLDDLKKSDYPSRRLIILGSITGNTNTLAGNVPPKAGLGDLRGLAGGLRGQNGSAMIDGAESFDGAKAYKDSKICNMLTMQEFHRRFHEETGITFASLYPGCIATTGLFREHIPLFRLLFPPFQRFVTKGFVSEAESGKRLAQVVGDPSLTKSGVYWSWNKDSASFENQLSQEASDPEKARKLWDLSEKLVGLA

SEQ ID NO: 295 - DNA, 1188 bp, Musa acuminata
  CDS (1)..(1188)
atggctctgcaggcgtccttccttccatcagctctctctgcccggaaagaggggaaggtggcctgcacagtcaaggaatctgcattcctcgggtcttccatcttggagcatcacaagtctcacccagttcttcgtactaagagggagtcgaatcattcagttggagtagtgaaagcccagaccacagcggttgcagctccagggctcaaccaatccgccgtgcacgggaagaaggtgctgcggaagggcgtggtggtaatcaccggcgcctcctcgggactcggcctcgccgctgccaaggctctcgccgagaccgagaaatggcacgttgtcatggcctgcagggacttcctcaaggccgagaaggccgcgcagtcggccggcatggccaaggagaactactccatcatgcacctggacctcgcatcgctcgacagcgtgcggcagttcgtccatgccttccggcagtccgggaggcccctcgacgtgctcgtgtgcaatgcggcgatctaccggcccaccgcccgcacgccgacgtacacggccgacgggtacgagatgagcgtcggcgtcaaccacctcgggcatttcctgctggccaacatgctcctcgaggacctgaagaaatccgattacccttctcgtcgcctcatcatcctcggctcgatcacagggaacaccaacacattggccgggaatgtgccgccaaaggccggactgggagacctgcgggggctcgcgggcggactcgacggccgcaacagctccgccatgatcgacggaggcgcgttcgacggggcgaaggcgtacaaggacagcaagatctgcaacatgctcacgatgcaggaattgcacaggaggttccacgaggacaccgggatcacattcgcgtcgctctacccgggctgcatcgccaccaccggcctcttcagagaacacatccccctgttccggctcctcttccctcctttccagaagttcatcacgaagggcttcgtctccgaggacgaatcagggcaaaggctcgcacaggtcgtgggcgatccgagcttgttgaagtctggagtgtactggagctggaacaataactcagcgagctttgagaaccagctatctgaggaagctagtgatgctgtgaaagcccagaagctgtgggagatcagtgagaagctggttgggttggcttaa

SEQ ID NO: 296 - protein, 395 aa, Musa acuminata
MALQASFLPSALSARKEGKVACTVKESAFLGSSILEHHKSHPVLRTKRESNHSVGVVKAQTTAVAAPGLNQSAVHGKKVLRKGVVVITGASSGLGLAAAKALAETEKWHVVMACRDFLKAEKAAQSAGMAKENYSIMHLDLASLDSVRQFVHAFRQSGRPLDVLVCNAAIYRPTARTPTYTADGYEMSVGVNHLGHFLLANMLLEDLKKSDYPSRRLIILGSITGNTNTLAGNVPPKAGLGDLRGLAGGLDGRNSSAMIDGGAFDGAKAYKDSKICNMLTMQELHRRFHEDTGITFASLYPGCIATTGLFREHIPLFRLLFPPFQKFITKGFVSEDESGQRLAQVVGDPSLLKSGVYWSWNNNSASFENQLSEEASDAVKAQKLWEISEKLVGLA

SEQ ID NO: 297 - DNA, 1200 bp, Nicotiana tabacum
  CDS (1)..(1200)
atggctctccaagcagcatctctgcttccttctgcattttctatccacaaagagggtaaatcatgtgctactctcaaggacagtagcctctttggagttgcattatcttacaatcaaaaatctaagttcattcctcctgctgcatggaacaaggaattgacaaagaaaatagcagctgtacctattagagcacaaatagccgctaccacaccagcagtcaaccagtctacctcagaacagaagaaaaccctcaggaaaggcaatgtgataattaccggagcctcctctggtttaggactagctacagcaaaggctataggtgaaacaggagagtggcacgttataatggcctgcagggacttccttaaggctgagaaagcagcaaaatccgtgggcattccaaaggaaaactacactgtcatgcatctggatctcgcttcccttgaaagcgtccgccaatttgtagatactttccgacgttcagggaggccacttgatgcgctagtctgcaatgccgcagtgtacttgccgactgctaaagagccaacttttactgctgacgggtttgagcttagtgtgggtaccaaccatcttggacatttcctgctttcaaggttgctgctagatgacctcaagcaatcagattacccacaaaagcgccttataattgttggctccattacaggaaacacaaacactttggctggaaacgtaccgccaaaggctaatcttggagatctacgaggactttcaggagggttgaatagtttaaactgctcacccatgattgatggaggagaatttgacggcgccaaagcctacaaagacagcaaagtctgtaacatgcttaccatgcaagagtttcataggcgtttccacgaggagactggcattgcctttgcgtccctctatcccggctgcattgctgaaactggtttgtttaggaatcacattcccttgttcagggctctcttcccaccatttcagaagtacattaccaaaggctatgtatctgaagcagaagcaggaaaaagacttgcacaggtcgtacgtgatccaagcctttcaaagtctggtgtctactggagttggaacaacacctcctcctcgtttgagaaccagctctcaaaagaagccagtgatgcagaaaaggcacgaaagctatgggaggtcagtgagaagcttgttggactggcttaa

SEQ ID NO: 298 - protein, 399 aa, Nicotiana tabacum
MALQAASLLPSAFSIHKEGKSCATLKDSSLFGVALSYNQKSKFIPPAAWNKELTKKIAAVPIRAQIAATTPAVNQSTSEQKKTLRKGNVIITGASSGLGLATAKAIGETGEWHVIMACRDFLKAEKAAKSVGIPKENYTVMHLDLASLESVRQFVDTFRRSGRPLDALVCNAAVYLPTAKEPTFTADGFELSVGTNHLGHFLLSRLLLDDLKQSDYPQKRLIIVGSITGNTNTLAGNVPPKANLGDLRGLSGGLNSLNCSPMIDGGEFDGAKAYKDSKVCNMLTMQEFHRRFHEETGIAFASLYPGCIAETGLFRNHIPLFRALFPPFQKYITKGYVSEAEAGKRLAQVVRDPSLSKSGVYWSWNNTSSSFENQLSKEASDAEKARKLWEVSEKLVGLA

SEQ ID NO: 299 - DNA, 1194 bp, Nicotiana tabacum
  CDS (1)..(1194)
atggctcttcaggctgctgctttggttccttctgctttctccatttccaaagagggcaaagctagtgcaaacttgaagaattctagtctttttggagtttcgctctctgactattctaaatctgattttggctcctcttcattcaaagtcaagagccaaagaagattgtccaatggagcagtaagggcaacaatggttgcatctccagatgtaaccactaattctccagcaggaaagaaaactttaagaaaaggatgtgtaatagtcactggagcctcttcaggattaggcctggccacagcaaaagcactatccgagaccggaaaatggcatgtgattatggcttgtagggactttttaaaagctgagaaagctgcaaaatcagttggtatgcctaaggagaattacaccatcatgcatttagaccttgcgtcgcttgacagcgttcgccagtttgtcgataacttcaggaggtccggtcgccctcttgatgtgttggttgctaatgcagctgtctatcaacctactgctaaagagccttcattcacagctgaaggatttgagattagtgttggcactaatcatcttggacatttccttctttcaagattgttgcttgacgacttgaagcaatctgattacccttcaaaaagactcataattgttggttcaattacagggaacacaaatactttggctggaaatgtacctccaaaggcgaatctcggtgacttgaggggtatggccgggggtttaaatggtattaacagttcagcgatgatcgatggtggggaatttgatggcgccaaagcgtacaaagacagcaaggtctgtaacatgctcacaatgcaggaattccatcgtcgataccacgaagaaactggcattacatttgcctctctttaccctggctgcattgcaacaacagggctattcagagaacatattcccttgtttaggctccttttccctccattccagaagtatattactaagggatttgtctctgagacagaagctggaaaacgacttgctcaggttgtaagtgatccaagcctgactaaatcaggtgtgtactggagctggaacaaagattcagcttcatttgagaaccagttgtctgaagaagctagtgatgtagagaaagcgcgtaaagtatgggaagtcagtgagaaactcgtcggtttggcttaa

SEQ ID NO: 300 - protein, 397 aa, Nicotiana tabacum
MALQAAALVPSAFSISKEGKASANLKNSSLFGVSLSDYSKSDFGSSSFKVKSQRRLSNGAVRATMVASPDVTTNSPAGKKTLRKGCVIVTGASSGLGLATAKALSETGKWHVIMACRDFLKAEKAAKSVGMPKENYTIMHLDLASLDSVRQFVDNFRRSGRPLDVLVANAAVYQPTAKEPSFTAEGFEISVGTNHLGHFLLSRLLLDDLKQSDYPSKRLIIVGSITGNTNTLAGNVPPKANLGDLRGMAGGLNGINSSAMIDGGEFDGAKAYKDSKVCNMLTMQEFHRRYHEETGITFASLYPGCIATTGLFREHIPLFRLLFPPFQKYITKGFVSETEAGKRLAQVVSDPSLTKSGVYWSWNKDSASFENQLSEEASDVEKARKVWEVSEKLVGLA

SEQ ID NO: 301 - DNA, 1218 bp, Arabidopsis thaliana
  CDS (1)..(1218)
atggcccttcaagctgcttctttggtctcctctgctttctctgtccgcaaagatggaaaattaaatgcttcagcatcatcatcattcaaagagtctagtctgttcggtgtttcactttcggagcaaagcaaagctgactttgtctcttcctcattgagatgcaagagggaacagagcttgaggaataataaagcgattattcgagctcaagcaatcgcgacttcaactccatcagtcacaaaatcttccttagaccgcaagaaaacacttagaaaaggaaacgtggttgtcacgggagcttcttcagggctaggtttagcaacggcaaaggcattagccgagacaggtaaatggcacgtgataatggcgtgcagagacttcctcaaggctgagagagccgctcaatctgcagggatgcctaaggacagctacactgtgatgcatttggacttggcgtctttggacagcgtgaggcagtttgttgataacttcaggcgagctgagatgcctctcgatgtgttggtctgcaatgccgcagtctatcagccaacggctaatcaacctactttcactgctgaagggtttgagcttagcgttgggataaaccatttgggccactttcttctttcaagattgttgattgatgacttgaagaactccgattatccatcaaaacgtctcatcattgttggatccataaccggaaacactaatacattggctggtaatgtacctccaaaggctaatcttggtgatttgaggggactagcaggcgggttgaacgggctaaacagctcggcgatgatagatggaggagattttgttggcgcaaaggcgtataaagatagcaaagtctgcaacatgttgacaatgcaggagtttcataggcgtttccatgaagacaccggcataacttttgcttccctttaccccggttgtattgcaacgactggtttgttcagagagcatattcctcttttccgtaccctcttccctcctttccagaagtacatcacaaaaggttacgtctccgagtcagaggctgggaaaagacttgctcaggtggtggctgatccaagcttgacgaagtcgggagtgtattggagctggaacaagacctcggcttcatttgagaatcagctgtctcaagaagctagcgatgtcgagaaggctcgtagagtttgggaagtcagcgagaagctcgtaggcttggcctaa

SEQ ID NO: 302 - protein, 405 aa, Arabidopsis thaliana
MALQAASLVSSAFSVRKDGKLNASASSSFKESSLFGVSLSEQSKADFVSSSLRCKREQSLRNNKAIIRAQAIATSTPSVTKSSLDRKKTLRKGNVVVTGASSGLGLATAKALAETGKWHVIMACRDFLKAERAAQSAGMPKDSYTVMHLDLASLDSVRQFVDNFRRAEMPLDVLVCNAAVYQPTANQPTFTAEGFELSVGINHLGHFLLSRLLIDDLKNSDYPSKRLIIVGSITGNTNTLAGNVPPKANLGDLRGLAGGLNGLNSSAMIDGGDFVGAKAYKDSKVCNMLTMQEFHRRFHEDTGITFASLYPGCIATTGLFREHIPLFRTLFPPFQKYITKGYVSESEAGKRLAQVVADPSLTKSGVYWSWNKTSASFENQLSQEASDVEKARRVWEVSEKLVGLA

SEQ ID NO: 303 - DNA, 1167 bp, Hordeum vulgare
  CDS (1)..(1167)
atggctctccagcttctcccctccaccctctccgtccccaagaagggcagcagcatgggcgcagtggcggtgaaggacacggcggcgttcctgggcgtgagcagcaaggcgaagaaggcgtcgctggcggtgaggacgcaggtggccacggcgccttcgccggtgacgacgagcccgggctcgaccgcgtcgtcgccgagcggcaagaagacgctgcggcagggcgtggtggtgatcacgggcgcgtcatccgggctgggcctggcggcggccaaggcgctggccgagacgggcaagtggcacgtcgtcatggcgtgccgcgacttcctcaaggcctccaaggcggccaaggcggcgggcatggcggacggcagctacaccgtcatgcacctcgacctcgcctccctcgacagcgtccggcagttcgttgacgcgttccgccgcgccgagatgccgctggatgtgctggtgtgcaacgccgccatctaccggcccacggcgcgcacgccgaccttcaccgccgacgggcacgagatgagcgtgggcgtgaaccacctgggccacttcctgctcgcccgcctcctcatggaggacctccagaagtccgactacccgtcccgccgcatggtcatcgtcggctccattaccggcaacagcaacacgctggcgggcaacgtgccgcccaaggccagcctcggcgacctccgcgggctggccggaggcctcagcggcgcgtccggctccgccatgatcgacggcgacgagagcttcgacggcgccaaggcgtacaaggacagcaaggtgtgcaacatgctgaccatgcaggagttccaccggcggtaccacgaggagaccggcatcaccttctcctcgctctacccgggctgcatcgccaccacggggctgttccgggagcacatcccgctgttccggaccctcttcccgccgttccagaagttcgtcaccaaggggttcgtgtcggaggcggagtccggcaagaggctggcgcaggtggtggcggagccagtcctgacaaagtccggcgtgtactggagctggaacaaggactcggcgtccttcgagaaccagctctcccaggaggccagcgaccccgagaaggcccgcaaggtctgggagctcagcgagaagctcgtcggactcgcatga

SEQ ID NO: 304 - protein, 388 aa, Hordeum vulgare
MALQLLPSTLSVPKKGSSMGAVAVKDTAAFLGVSSKAKKASLAVRTQVATAPSPVTTSPGSTASSPSGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFVTKGFVSEAESGKRLAQVVAEPVLTKSGVYWSWNKDSASFENQLSQEASDPEKARKVWELSEKLVGLA

SEQ ID NO: 305 - DNA, 1167 bp, Triticum aestivum
  CDS (1)..(1167)
atggctctccagctcctcccctccaccctctccgtccccaagaagggtagcagcatgggcgcggcggcagtgaaggacacggcggcgttcctgggcgtgagcagcaaggcgaagaaggcgtcgctagcggtgaggacgcaggtggccacggcgccttcgtcggtgacgacgagcccgggctcggcgacggcgaagccgagcggcaagaagacgctgcggcagggcgtggtggtgatcacgggcgcgtcgtccgggctgggtctggcggcggccaaggcgctggcagagacgggcaagtggcacgtggtcatggcgtgccgcgacttcctcaaggcatccaaggcggccaaggcggcaggcatggcagacggcagctacaccgtcatgcacctcgacctcgcctcgctcgacagcgtccggcagttcgtggatgcgttccgccgcgcagagatgccgctggacgtgctcgtgtgcaacgccgccatttaccgccccacggcgcgcacgccgaccttcaccgccgacgggcacgagatgagcgtgggcgtgaaccacctcggccacttcctgctcgcccgcctcctcatggaggacctccagaagtccgactacccgtcccgccgcatggtcatcgtcggctccatcaccggcaacagcaacacgctggcgggcaacgtgccgcccaaggccagcctcggcgacctccgcgggctcgccggcggcctcagcggcgcgtcgggctccgccatgatcgacggcgacgagagcttcgacggcgccaaggcgtacaaggacagcaaggtgtgcaacatgctgaccatgcaggagttccaccggcggtaccacgaggagaccggcatcaccttctcgtcgctctaccccggctgcatcgccaccacggggctgttccgcgagcacatcccgctgttccggaccctgttcccgccgttccaaaagttcgtgaccaaggggttcgtgtccgaggcagagtccggcaagaggctggcgcaggtggtggcggagcccagcctgaccaagtccggcgtgtactggagctggaacaaggactcggcgtcgttcgagaaccagctctcacaggaggccagcgaccccgagaaggcccgcaaggtctgggagctcagcgagaagctcgtcggactcgcctga

SEQ ID NO: 306 - protein, 388 aa, Triticum aestivum
MALQLLPSTLSVPKKGSSMGAAAVKDTAAFLGVSSKAKKASLAVRTQVATAPSSVTTSPGSATAKPSGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFVTKGFVSEAESGKRLAQVVAEPSLTKSGVYWSWNKDSASFENQLSQEASDPEKARKVWELSEKLVGLA

SEQ ID NO: 307 - DNA, 1188 bp, Hordeum vulgare
  CDS (1)..(1188)
atggctcttcaggcggccacttccttcctcccgtcggccctctccgcgcgcaaggagggagcggccaaggactcggccttcttcggcgtacgtctcgccgatggcctcaaattggacgccacctccctcggcctgcgcaccaagagagtgaacacgtcgtcggtggccatccgcgcgcaggccgcggcggtgtccgcgccgacagcaaccccggcgtcgccggccggcaagaagactgtccgcacgggcaacgcgatcatcacgggcgcgtcgtcgggcctcggcctcgccacggccaaggccctggcggagtcaggcaagtggcacgtcatcatggcgtgccgcgactacctcaagaccgcgcgcgcggccagggcggccggcatgcccaagggcagctacaccatcgtgcaccttgatctggcctccctcgacagcgtccgccagttcgtcaagaacgtgcgccagctcgacatgcccatcgacgtcgtcgtctgcaacgccgccgtgtaccagcccaccgccaaggagccttccttcaccgcggacggcttcgagatgagcgtcggcgtcaaccacctcggccacttcctcctcgcccgcgagctcctcgaggacctcaaggcctccgactacccctccaagcgcctcatcatcgtcggctccattaccgggaacacgaacacgcttgccgggaacgtgccgccgaaggccaacctgggggacctgaggggcctcgcggccgggctgaacggcgtgggcagcgccgccatgatcgacggcgcggagttcgacggcgccaaggcttacaaggacagcaaggtgtgcaacatgctgaccatgcaggagttccaccggcggtaccacgaggagaccggcgtcaccttcgcgtcgctctacccggggtgcatcgccaccacggggctcttccgtgaacacatccctctgttccgcctcctcttcccgccgttccagaagtacatcaccaaggggtacgtgtccgaggaggaggccggcaagaggctggcgcaggtcgtcagcgagcccagcctcaccaagtccggcgtctactggagctggaacaaaaactcggcgtccttcgagaaccagctctccgaggaggccagcgacaccgagaaggccaggaaggtctgggagctcagcgagaagctcgtcgggctcgcatga

SEQ ID NO: 308 - protein, 395 aa, Hordeum vulgare
MALQAATSFLPSALSARKEGAAKDSAFFGVRLADGLKLDATSLGLRTKRVNTSSVAIRAQAAAVSAPTATPASPAGKKTVRTGNAIITGASSGLGLATAKALAESGKWHVIMACRDYLKTARAARAAGMPKGSYTIVHLDLASLDSVRQFVKNVRQLDMPIDVVVCNAAVYQPTAKEPSFTADGFEMSVGVNHLGHFLLARELLEDLKASDYPSKRLIIVGSITGNTNTLAGNVPPKANLGDLRGLAAGLNGVGSAAMIDGAEFDGAKAYKDSKVCNMLTMQEFHRRYHEETGVTFASLYPGCIATTGLFREHIPLFRLLFPPFQKYITKGYVSEEEAGKRLAQVVSEPSLTKSGVYWSWNKNSASFENQLSEEASDTEKARKVWELSEKLVGLA

SEQ ID NO: 309 - DNA, 1206 bp, Arabidopsis thaliana
  CDS (1)..(1206)
atggctctccaagctgcctattctcttcttccttctaccatttcaatccaaaaagagggcaaattcaatgcttctctaaaggagacgacttttactggttcttcattttcaaaccatcttagagctgaaaagatatccaccctgttgaccatcaaggaacagagaagacagaaaccgcgattttccaccggtattcgtgcacagacagttacagccacgccgccggcaaacgaagcatcgccggagcaaaagaagactgagagaaaaggcactgcagtgatcactggagcttcgtctggtttaggtttagctacggccaaagctttagcagacacagggaaatggcatgtgatcatggcttgcaggaactttctcaaggccgagaaggcagcgagatctgttggaatgtccaaggaagattacacagtgatgcatcttgatcttgcttcgcttgaaagcgtgaagcaattcgttgaaaatttccggagaacagaacaaccactcgatgttcttgtctgcaatgccgcggtttaccaaccaactgctaaagagccttcttttacagctgaaggctttgagataagcgttggaaccaaccatctcggtcactttcttctctcaagattgcttcttgatgacctgaaaaaatctgattatccatcaaaacgtatgatcatcgtaggatctataacaggaaacacaaatactttggctgggaatgtaccgccaaaggcaaaccttggagacctaagaggcttagcgtcaggattgaatgggcaaaacagttcaatgatagatggaggagagtttgatggagcaaaggcttacaaagacagcaaagtatgcaatatgctgacaatgcaggagcttcacagacgttaccacgaggaaacaggagtcacgtttgcttctctttaccctggttgcatcgctacaacagggttgttcagagaacacataccgctgtttcggcttctttttccgccttttcaaaagtatatcaccaaaggttacgtatctgaagaggaagctggcaaaagactagcacaggttgtgagtgaccctagtcttgggaagtcaggagtgtattggagttggaacaataactcgtcttcgtttgagaatcagctttctaaagaagcaagtgatgcggagaaggcaaagaaactgtgggaggttagcgagaagcttgttggtttggcatga

SEQ ID NO: 310 - protein, 401 aa, Arabidopsis thaliana
MALQAAYSLLPSTISIQKEGKFNASLKETTFTGSSFSNHLRAEKISTLLTIKEQRRQKPRFSTGIRAQTVTATPPANEASPEQKKTERKGTAVITGASSGLGLATAKALADTGKWHVIMACRNFLKAEKAARSVGMSKEDYTVMHLDLASLESVKQFVENFRRTEQPLDVLVCNAAVYQPTAKEPSFTAEGFEISVGTNHLGHFLLSRLLLDDLKKSDYPSKRMIIVGSITGNTNTLAGNVPPKANLGDLRGLASGLNGQNSSMIDGGEFDGAKAYKDSKVCNMLTMQELHRRYHEETGVTFASLYPGCIATTGLFREHIPLFRLLFPPFQKYITKGYVSEEEAGKRLAQVVSDPSLGKSGVYWSWNNNSSSFENQLSKEASDAEKAKKLWEVSEKLVGLA

SEQ ID NO: 311 - DNA, 1197 bp, Daucus carota
  CDS (1)..(1197)
atggctcttcaggctgcttctttccttccctcttctttctccatcaacaaagagggcaaggccaatgtttctttgaaggaaactagtctttttggagttacattttctgacagtctcaggactgacttcagctctctgaggaccaggaggggttgtaggcaaatatcacagaccggagctataagatcacaagcagtggcgacgactccttctgtcaacagggcgacaggcgaaggcaagaagaccttgaggaagggaagtgtgatcattactggagcctcctcagggttgggcttggccacggccaaggcactggcggaaacaggcaaatggcatgtgattatggcctgcagggactttctcaaggccgaaagagcagctaaatcagctggcatgcctaaggagaattacacaataatgcatttggacctagcgtcgcttgatagtgttaggcagtttgtagagacgtttaggcgatcagagaggccgcttgatgtgcttgtttgcaatgcagcagtgtatttccctactgctaaggagcctacttacacagctgatggatttgaacttagtgttgggactaaccatttgggccatttcttgctttcaagattgctgctcgatgacttgaacaaatctgattacccgtccaagagactcattattgttggttccatcacaggcaacacaaacacattggccgggaatgtacctccaaaggccaacctgggagacttgaggggtcttgcaggcggtctaaatgggatgaacagctccgccatgatagacggtgcagaatttgatggtgcaaaagcttacaaggacagcaaggtctgcaacatgctcacaatgcaagaattccaccgtcgataccacgaggaaactgggatcacatttgcatccttgtacccaggctgcattgccacaactggtttgtttagggagcatattcccctcttcaggaccctcttcccaccattccaaaagtacatcaccaagggctatgtgtctgaagcagaatccggaaagcgattggcacaggttgtgagtgaaccaagcctgaccaaatcaggtgtctactggagctggaacaaggactctgcctcattcgaaaaccagttgtctgaagaagctagtgatgtagagaaggctcgtaaagtatgggaagtgagtgagaagcttgttggtttggcctaa

SEQ ID NO: 312 - protein, 398 aa, Daucus carota
MALQAASFLPSSFSINKEGKANVSLKETSLFGVTFSDSLRTDFSSLRTRRGCRQISQTGAIRSQAVATTPSVNRATGEGKKTLRKGSVIITGASSGLGLATAKALAETGKWHVIMACRDFLKAERAAKSAGMPKENYTIMHLDLASLDSVRQFVETFRRSERPLDVLVCNAAVYFPTAKEPTYTADGFELSVGTNHLGHFLLSRLLLDDLNKSDYPSKRLIIVGSITGNTNTLAGNVPPKANLGDLRGLAGGLNGMNSSAMIDGAEFDGAKAYKDSKVCNMLTMQEFHRRYHEETGITFASLYPGCIATTGLFREHIPLFRTLFPPFQKYITKGYVSEAESGKRLAQVVSEPSLTKSGVYWSWNKDSASFENQLSEEASDVEKARKVWEVSEKLVGLA

SEQ ID NO: 313 - DNA, 1200 bp, Pisum sativum
  CDS (1)..(1200)
atggctcttcaaactgcttctatgcttcctgcttctttctccattcccaaagaggggaagattggtgcgtctctcaaggactcgactctttttggtgtttcatcattgtctgattctttgaaaggtgatttcacctcttctgcattgaggtgtaaggaattacgacaaaaagttggtgctgtgagggcggagacagcggctccggccactccagcagttaacaagtcatcatctgaagggaagaagacgttgaggaaaggaaatgttgtgatcactggtgcttcatctggtttaggtctagctactgctaaggctttggctgaatcaggaaaatggcatgtaattatggcttgcagggactacctcaaagctgcaagagctgcaaaatcggctggattggctaaggaaaactacacgattatgcatttagaccttgcgtctcttgacagtgttcgtcaatttgttgataacttcagaagatctgaaatgccattggatgtgcttattaacaatgctgctgtttactttccaactgctaaggaacctagtttcacggcggatggctttgaaattagtgttgggacaaaccatcttgggcattttcttctttcgcgccttttgcttgaggaccttaaaaaatccgattacccttcaaagcgcttgatcattgtcggctcaatcacaggtaacacaaacacattggctggaaatgttccgccgaaggctaacctcggtgacttgagaggacttgctggtggcttgactggacttaacagttcggccatgatagacggtggagattttgatggtgccaaggcatacaaggacagcaaagtctgtaatatgctcacaatgcaagagttccatagaagatatcatgaggaaactggaatcacatttgcttccctttaccctggttgcattgccacaacaggcttgtttagagagcacattcccttgttcagaactctattccctccattccaaaagtacataaccaaaggctacgtctcagaagaagaatcgggaaagagacttgctcaggttgtaagtgatccaagcctaacaaaatctggtgtttactggagctggaataacgcttctgcttcatttgagaaccagctatcacaagaggccagtgatgccgagaaggctcgcaaggtgtgggaggttagtgagaagcttgttggtttggcctaa

SEQ ID NO: 314 - protein, 399 aa, Pisum sativum
MALQTASMLPASFSIPKEGKIGASLKDSTLFGVSSLSDSLKGDFTSSALRCKELRQKVGAVRAETAAPATPAVNKSSSEGKKTLRKGNVVITGASSGLGLATAKALAESGKWHVIMACRDYLKAARAAKSAGLAKENYTIMHLDLASLDSVRQFVDNFRRSEMPLDVLINNAAVYFPTAKEPSFTADGFEISVGTNHLGHFLLSRLLLEDLKKSDYPSKRLIIVGSITGNTNTLAGNVPPKANLGDLRGLAGGLTGLNSSAMIDGGDFDGAKAYKDSKVCNMLTMQEFHRRYHEETGITFASLYPGCIATTGLFREHIPLFRTLFPPFQKYITKGYVSEEESGKRLAQVVSDPSLTKSGVYWSWNNASASFENQLSQEASDAEKARKVWEVSEKLVGLA

SEQ ID NO: 315 - protein, 410 aa, Artificial sequence
  Description of artificial sequence: consensus sequence
  Variant (7)..(8): Xaa in position 7 to 8 is any amino acid
  Variant (9)..(12): Xaa in position 9 to 12 is any or no amino acid
  Variant (15)..(16): Xaa in position 15 to 16 is any amino acid
  Variant (18)..(19): Xaa in position 18 to 19 is any amino acid
  Variant (20)..(20): Xaa in position 20 is any or no amino acid
  Variant (22)..(22): Xaa in position 22 is any amino acid
  Variant (24)..(40): Xaa in position 24 to 40 is any amino acid
  Variant (41)..(80): Xaa in position 41 to 80 is any or no amino acid
  Variant (82)..(88): Xaa in position 82 to 88 is any amino acid
  Variant (89)..(89): Xaa in position 89 is any or no amino acid
  Variant (94)..(94): Xaa in position 94 is any amino acid
  Variant (96)..(96): Xaa in position 96 is any amino acid
  Variant (98)..(100): Xaa in position 98 to 100 is any amino acid
  Variant (112)..(112): Xaa in position 112 is any amino acid
  Variant (125)..(125): Xaa in position 125 is any amino acid
  Variant (135)..(136): Xaa in position 135 to 136 is any amino acid
  Variant (139)..(141): Xaa in position 139 to 141 is any amino acid
  Variant (144)..(147): Xaa in position 144 to 147 is any amino acid
  Variant (150)..(150): Xaa in position 150 is any amino acid
  Variant (166)..(167): Xaa in position 166 to 167 is any amino acid
  Variant (170)..(173): Xaa in position 170 to 173 is any amino acid
  Variant (177)..(177): Xaa in position 177 is any amino acid
  Variant (184)..(184): Xaa in position 184 is any amino acid
  Variant (186)..(186): Xaa in position 186 is any amino acid
  Variant (190)..(191): Xaa in position 190 to 191 is any amino acid
  Variant (193)..(194): Xaa in position 193 to 194 is any amino acid
  Variant (197)..(197): Xaa in position 197 is any amino acid
  Variant (199)..(199): Xaa in position 199 is any amino acid
  Variant (201)..(201): Xaa in position 201 is any amino acid
  Variant (205)..(205): Xaa in position 205 is any amino acid
  Variant (214)..(214): Xaa in position 214 is any amino acid
  Variant (216)..(216): Xaa in position 216 is any amino acid
  Variant (219)..(219): Xaa in position 219 is any amino acid
  Variant (222)..(223): Xaa in position 222 to 223 is any amino acid
  Variant (229)..(229): Xaa in position 229 is any amino acid
  Variant (234)..(234): Xaa in position 234 is any amino acid
  Variant (253)..(253): Xaa in position 253 is any amino acid
  Variant (262)..(262): Xaa in position 262 is any amino acid
  Variant (265)..(265): Xaa in position 265 is any amino acid
  Variant (267)..(269): Xaa in position 267 to 269 is any amino acid
  Variant (276)..(277): Xaa in position 276 to 277 is any amino acid
  Variant (278)..(278): Xaa in position 278 is any or no amino acid
  Variant (290)..(290): Xaa in position 290 is any amino acid
  Variant (299)..(299): Xaa in position 299 is any amino acid
  Variant (303)..(303): Xaa in position 303 is any amino acid
  Variant (309)..(309): Xaa in position 309 is any amino acid
  Variant (334)..(334): Xaa in position 334 is any amino acid
  Variant (342)..(343): Xaa in position 342 to 343 is any amino acid
  Variant (347)..(347): Xaa in position 347 is any amino acid
  Variant (351)..(351): Xaa in position 351 is any amino acid
  Variant (353)..(353): Xaa in position 353 is any amino acid
  Variant (362)..(362): Xaa in position 362 is any amino acid
  Variant (377)..(378): Xaa in position 377 to 378 is any amino acid
  Variant (388)..(388): Xaa in position 388 is any amino acid
  Variant (393)..(393): Xaa in position 393 is any amino acid
  Variant (397)..(397): Xaa in position 397 is any amino acid
  Variant (399)..(399): Xaa in position 399 is any amino acid
  Variant (402)..(402): Xaa in position 402 is any amino acid
MALQAAXXXXXXPSXXSXXXKXGXXXXXXXXXXXXXXXXXXXXXXXXXXXXXXXXXXXXXXXXXXXXXXXXXXXXXXXXXPXXXXXXXXGKKTXRXGXXXITGASSGLGLAXAKALAETGKWHVXMACRDFLKAXXAAXXXGMXXXXYTXMHLDLASLDSVRQFVXXFRXXXXPLDXLVCNAAXYXPTAXXPXXTAXGXEXSVGXNHLGHFLLXRXLLXDLXXSDYPSXRLIIXGSITGNTNTLAGNVPPKAXLGDLRGLAXGLXGXXXSAMIDGXXXFDGAKAYKDSKXCNMLTMQEXHRRXHEETGXTFASLYPGCIATTGLFREHIPLFRXLFPPFQKXXTKGXVSEXEXGKRLAQVVXDPSLTKSGVYWSWNXXSASFENQLSXEASDXEKAXKXWEXSEKLVGLA

SEQ ID NO: 316 - protein, 60 aa, Artificial sequence
  Description of artificial sequence: amino acid sequence pattern comprised in a variant of SEQ ID NO: 274
  Variant (6)..(6): Xaa in position 6 is Ile or Val
  Variant (15)..(15): Xaa in position 15 is Phe or Leu
  Variant (19)..(19): Xaa in position 19 is Phe or Tyr
  Variant (25)..(25): Xaa in position 25 is Ile or Val
  Variant (26)..(26): Xaa in position 26 is Ala or Thr
  Variant (28)..(28): Xaa in position 28 is Ala or Ser
  Variant (37)..(37): Xaa in position 37 is Glu, Ser or Thr
  Variant (43)..(43): Xaa in position 43 is Glu or Asn
  Variant (50)..(50): Xaa in position 50 is any amino acid
  Variant (57)..(57): Xaa in position 57 is Lys or Arg
  Variant (58)..(58): Xaa in position 58 is Phe or Tyr
  Variant (59)..(59): Xaa in position 59 is Ile or Val
YKDSKXCNMLTMQEXHRRXHEETGXXFXSLYPGCIAXTGLFRXHIPLFRXLFPPFQXXXT

SEQ ID NO: 317 - protein, 61 aa, Artificial sequence
  Description of artificial sequence: amino acid sequence pattern comprised in a variant of SEQ ID NO: 274
  Variant (3)..(3): Xaa in position 3 is Phe or Tyr
  Variant (7)..(7): Xaa in position 7 is any or no amino acid
  Variant (9)..(9): Xaa in position 9 is any amino acid
  Variant (10)..(10): Xaa in position 10 is any or no amino acid
  Variant (19)..(19): Xaa in position 19 is any amino acid
  Variant (20)..(20): Xaa in position 20 is Asp or Glu
  Variant (24)..(24): Xaa in position 24 is Gly, Ser or Thr
  Variant (34)..(34): Xaa in position 34 is any amino acid
  Variant (35)..(35): Xaa in position 35 is Ala, Asp, Asn or Thr
  Variant (37)..(37): Xaa in position 37 is Ala or Ser
  Variant (45)..(45): Xaa in position 45 is any amino acid
  Variant (50)..(50): Xaa in position 50 is Ala, Pro, Thr or Val
  Variant (51)..(51): Xaa in position 51 is Asp or Glu
  Variant (54)..(54): Xaa in position 54 is Lys or Arg
  Variant (56)..(56): Xaa in position 56 is Ile, Leu or Val
  Variant (58)..(58): Xaa in position 58 is Asp or Glu
  Variant (59)..(59): Xaa in position 59 is Ile, Leu or Val
KGXVSEXEXXGKRLAQVVXXPSLXKSGVYWSWNXXSXSFENQLSXEASDXXKAXKXWXXSE

SEQ ID NO: 318 - protein, 58 aa, Artificial sequence
  Description of artificial sequence: amino acid sequence pattern comprised in a variant of SEQ ID NO: 274
  Variant (2)..(2): Xaa in position 2 is any amino acid
  Variant (8)..(8): Xaa in position 8 is Phe or Tyr
  Variant (12)..(12): Xaa in position 12 is Ala, Glu or Ser
  Variant (13)..(13): Xaa in position 13 is any amino acid
  Variant (16)..(16): Xaa in position 16 is any amino acid
  Variant (17)..(17): Xaa in position 17 is Ala, Gly or Ser
  Variant (18)..(18): Xaa in position 18 is Ala or Val
  Variant (20)..(20): Xaa in position 20 is Ile, Leu or Met
  Variant (21)..(21): Xaa in position 21 is Ala, Asp or Pro
  Variant (22)..(22): Xaa in position 22 is any amino acid
  Variant (23)..(23): Xaa in position 23 is Asp, Glu or Gly
  Variant (24)..(24): Xaa in position 24 is Asn or Ser
  Variant (25)..(25): Xaa in position 25 is Phe or Tyr
  Variant (26)..(26): Xaa in position 26 is Ser or Thr
  Variant (27)..(27): Xaa in position 27 is Ile or Val
  Variant (28)..(28): Xaa in position 28 is Met or Val
  Variant (36)..(36): Xaa in position 36 is Asp or Glu
  Variant (43)..(43): Xaa in position 43 is Asp, Glu, His, Lys or Arg
  Variant (44)..(44): Xaa in position 44 is Ala, Asn, Ser or Thr
  Variant (45)..(45): Xaa in position 45 is Phe or Val
  Variant (47)..(47): Xaa in position 47 is Gln or Arg
  Variant (48)..(48): Xaa in position 48 is any amino acid
  Variant (49)..(49): Xaa in position 49 is Glu or Gly
  Variant (50)..(50): Xaa in position 50 is any amino acid
  Variant (52)..(52): Xaa in position 52 is Ile, Leu or Val
  Variant (54)..(54): Xaa in position 54 is Ala, Ser or Val
  Variant (55)..(55): Xaa in position 55 is Leu or Val
  Variant (56)..(56): Xaa in position 56 is Ile or Val
  Variant (57)..(57): Xaa in position 57 is Ala, Cys or Asn
VXMACRDXLKAXXAAXXXGXXXXXXXXXHLDLASLXSVRQFVXXXRXXXXPXDXXXXN

SEQ ID NO: 319 - protein, 21 aa, Artificial sequence
  Description of artificial sequence: amino acid sequence pattern comprised in a variant of SEQ ID NO: 274
  Variant (2)..(2): Xaa in position 2 is Leu or Met
  Variant (5)..(5): Xaa in position 5 is Leu or Met
  Variant (6)..(6): Xaa in position 6 is Ala or Gln
  Variant (7)..(7): Xaa in position 7 is Ala, Gly or Ser
  Variant (10)..(10): Xaa in position 10 is any amino acid
  Variant (12)..(13): Xaa in position 12 to 13 is any amino acid
  Variant (14)..(14): Xaa in position 14 is any or no amino acid
  Variant (16)..(16): Xaa in position 16 is any or no amino acid
DXRGXXXGLXGXXXSXAMIDG

SEQ ID NO: 320 - protein, 8 aa, Artificial sequence
  Description of artificial sequence: amino acid sequence pattern comprised in a variant of SEQ ID NO: 274
  Variant (3)..(3): Xaa in position 3 is Ile or Val
  Variant (5)..(5): Xaa in position 5 is any amino acid
AAXYXPTA

SEQ ID NO: 321 - DNA, 801 bp, Arabidopsis thaliana
  CDS (1)..(801)
atggccgcctcgacaatggctctctcctctcctgctttgaccggaaaggccgttaagctatccccggcggcctccgaagtatttggaaccggccgaatcaccatgcgcaaagcctccaagcccaccggtccatccggcagcccatggtacggatccgaccgagtcaagtacttgggtccattctccggtgagcctccgagctacctcactggagagttccccggtgattacgggtgggacactgccggtctatccgccgatcccgagaccttcgctaggaaccgtgagctagaagttatccacagcagatgggccatgctcggagccctaggctgcgttttccctgagctattggctaggaacggagtgaagttcggagaagcggtttggttcaaggctggttcacagatcttcagcgacggaggattggactacttgggcaacccgagcttggtccacgctcagagcatcttagccatttgggctactcaagttatcctcatgggagctgttgagggctacagagtcgccggagatggtccattgggagaagcagaggacttgctttacccaggtgggagcttcgacccattgggcctcgctactgaccccgaggctttcgcggagttgaaggtgaaggagctcaagaacggaaggttggctatgttctctatgtttggattcttcgttcaggccattgtcaccggaaagggaccgttggagaacctcgcggaccacttggctgatccagtcaacaacaatgcatgggccttcgctaccaacttcgtccccggaaagtga

SEQ ID NO: 322 - protein, 266 aa, Arabidopsis thaliana
MAASTMALSSPALTGKAVKLSPAASEVFGTGRITMRKASKPTGPSGSPWYGSDRVKYLGPFSGEPPSYLTGEFPGDYGWDTAGLSADPETFARNRELEVIHSRWAMLGALGCVFPELLARNGVKFGEAVWFKAGSQIFSDGGLDYLGNPSLVHAQSILAIWATQVILMGAVEGYRVAGDGPLGEAEDLLYPGGSFDPLGLATDPEAFAELKVKELKNGRLAMFSMFGFFVQAIVTGKGPLENLADHLADPVNNNAWAFATNFVPGK

SEQ ID NO: 323 - DNA, 1107 bp, Glycine max
  CDS (189)..(983)
ctcgagccgctccaaatacaagccaatagaaattgaaatatagatcatcataagatattaagataaggacccatttcctgcttctaagctatatagtgctcgtctagcctacccactacaagcaacattgttaaccattctcttcactttaaagttacatagtttttcattgttttacttaatctacaatggctgcttcaacaatgactctctcttcatcatcattggctggccaagctatcaagcttgccccctccacccctgagcttggtgttggaagggttagcatgaggaaaacagcctccaagactgtttcctcaggaagcccatggtacggcccagaccgtgtcaagtacttgggcccattctctggtgagcccccatcctatctcactggtgaattcccaggtgactatggttgggacactgctgggctttctgctgacccagagacttttgccaaaaaccgtgaactggaagtcatccactccagatgggccatgttgggagccttgggctgtgttttccctgaactcttgtcccgcaacggtgtcaagtttggcgaggccgtgtggttcaaggccgggtctcagatattcagtgagggtgggcttgactacttgggcaacccaagcctgatccatgcacaaagcattcttgccatctgggccacccaagttatcttgatgggtgccgttgagggttaccgtattgctggtgggcctcttggtgaggtgactgacccaatctacccaggtggcagctttgacccattgggccttgctgatgacccagaggcttttgctgagttgaaggtgaaagagctcaagaatggtaggttggccatgttctccatgtttggtttctttgttcaggcaattgtgacaggaaagggacccttagaaaaccttgctgatcaccttgcagacccagtcaacaacaatgcttgggcctatgccacaaactttgtccccggaaagtgagggaaaaaaaataaacctgaaacgatgagaaactatgacttgagtgtgaatttcatgttgttatttaatgaaatatatattggatgtgtgccttatatatctttttggaacgttttgattggtc

SEQ ID NO: 324 - protein, 264 aa, Glycine max
MAASTMTLSSSSLAGQAIKLAPSTPELGVGRVSMRKTASKTVSSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 325 - DNA, 1046 bp, Glycine max
  CDS (47)..(838)
ctccataacacaaggcagaaagcaagctcatcctagagttttaaaaatggcagcagcctcctccatggctctctcttccccatccttggctggcaaggccgtgaagctgggcccatcagcccccgaagtcgggagggtcagcatgaggaagaccgtcaccaagcaggcctcctccggaagcccatggtacggcccagaccgcgtcaagtacttgggcccattctctggcgagcccccgtcctacctcactggcgagttcccaggtgactacggctgggacactgctgggctttcggccgacccagaaaccttcgccagaaaccgtgagctcgaagtgatccactccaggtgggccatgctcggggccttgggctgcgtcttccccgaactgttgtcccgcaacggggtcaagtttggagaagctgtgtggttcaaggccgggtcccagatcttcagcgagggtgggctggactacttgggcaacccaagccttgtccacgcccagagcatcctcgccatctgggccacccaagttatcctaatgggtgctgttgagggttatcgtattgctggtgggcccctcggtgaggtcactgacccaatctaccctggtggcagctttgacccattgggccttgctgatgacccagaggcttttgctgagcttaaggtgaaggaactcaagaacgggagattggccatgttctctatgtttgggttctttgttcaggccattgtcaccggtaagggtccattggagaaccttgctgatcaccttgcggacccagtcaacaacaatgcctgggcctacgccaccaacttcgtccccggcaagtgagcatgaaagaaaaggatgaattgtggacttttgagagtttttagatttgtgtttggtgaagtatatgttattgcaatgtacttcagataatgtgaattatcttgtgtatcccaatccaacttaatgttacttgctttttacgaaaactcaagtgtcaatttgttctctcattttacacttctatgcttatgacaccaaattgaactct

SEQ ID NO: 326 - protein, 263 aa, Glycine max
MAAASSMALSSPSLAGKAVKLGPSAPEVGRVSMRKTVTKQASSGSPWYGPDRVKYLGPFSGEPPSYLTGEFPGDYGWDTAGLSADPETFARNRELEVIHSRWAMLGALGCVFPELLSRNGVKFGEAVWFKAGSQIFSEGGLDYLGNPSLVHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 327 - DNA, 1442 bp, Glycine max
  CDS (95)..(892)
cccacgcgtccgtacggctgcgagaagacgacagaaggggacaacacagaacaaaaacaaagaaaaaaaaaaacccttagccaacacaaccatcatggccacctctgctattcagcaatcagcattcactggtcaaactgctctgaagcagctcaatgagttcgtccgcaagaccggtggcgccggcaaaggtcgcactaacatgcgccgcaccgtcaagagtgctcctcagagcatttggtatggccctgaccgtcccaagtacttgggtccattctcggagcagattccatcatacctgaccggagaattccctggtgactacggatgggacactgctggattatcagctgacccggaaaccttcgccaggaaccgggagctggaggtgattcacagcagatgggcaatgcttggtgcccttggctgcaccttcccagagatccttgagaagaatggtgtcaaattcggcgaggccgtgtggttcaaggccggtgcacagatcttctcagagggaggccttgactacttgggcaacccaaacctgatccatgctcagagcatccttgctatctgggctgttcaggttgtgctcatggggtttgttgaaggttacagagttggtggaggaccacttggtgaaggacttgaccctatctaccctggtggtgcttttgaccctcttggtctggctgatgaccctgatgcattcgctgagttgaaggtcaaggaactcaagaacggtcgcttggctatgttctccatgtttggtttctttgttcaggctattgtcactggcaagggccctattcagaacctttacgaccacgttgctgatcctgttgccaacaatgcttgggcttatgccactaactttgtccctggacaatgaggatgcctacatgcaatgcaatcttctgctcccttttgcagttcccttgtgtttaactccattttcactaatgtaactacacctgtgtagcagaaaaatctgtatgagaaccattatatttttatatattagaaatttgggtccccagaaaatatcaactcttacgtttggaattcaagttaactagttcaaacgttgaaaccatgttcaaggaatctatctattagtgatgtacgtgccttgtacaccatccaattcaaagccatgattaaaaccataaacgaatgaatccatcttccattaccaacaacatccaaagcccacaaggccacaacaagagaaagagcaggcgggcattcaatgtatccatctaaatgcgtcaataatgtagtaagtcataagaaaattaaaaaacaaagaagtgatgaaggggaaggtagtaatgcaaaagctatgatttgaaaacaaaaaaaacaagtactcttagcttaccactttctttttgctcatttggaaagaatacaaatagcatacgattttagattttttt

SEQ ID NO: 328 - protein, 265 aa, Glycine max
MATSAIQQSAFTGQTALKQLNEFVRKTGGAGKGRTNMRRTVKSAPQSIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIQNLYDHVADPVANNAWAYATNFVPGQ

SEQ ID NO: 329 - DNA, 1010 bp, Zea mays
  CDS (77)..(868)
  misc_feature (64)..(64): n is a, g, c or t
  misc_feature (998)..(998): n is a, g, c or t
ctcgaggccggccaggaccacttcaaaacactcataacacaaagcacaaagcaaagctcatccnttgagttaaaaaatggcagcagcttcttccatggctctctcatccccatccttggctggcaaggccgtgaagctgggcccatcagccccagaagtgggaagggtgagcatgaggaagaccgtcaccaagcaggtctcctcaggaagcccatggtacggcccagaccgcgtcaagtacttgggcccattctctggcgagcccccgtcctacctaaccggcgagttcccaggcgactacggctgggacactgctgggctttccgcagacccagaaaccttcgccaagaaccgtgagctcgaagtgatccactccaggtgggccatgctcggggccttgggctgcgtcttccccgaactgttgtcccgcaacggggtcaagtttggagaagctgtgtggttcaaggccgggtcccagatcttcagcgagggtgggctggactacttgggcaacccaagccttgtccacgcccagagcatcctcgccatctgggccacccaagttatcctaatgggtgctgttgagggttatcgtattgctggtgggcccctcggtgaggtcactgacccaatctaccctggtggcagctttgacccattgggccttgctgatgacccagaggcttttgctgagcttaaggtgaaggaactcaagaacgggcgattggccatgttctctatgtttgggttctttgttcaggccattgtcaccggtaagggtccattggagaaccttgctgatcaccttgcggacccagtcaacaacaatgcctgggcctacgccaccaacttcgtccccggcaagtgagcatgaaagaaaaggatgacttgtggacttttgagagtttttagatttgtgtttggtggagtatatgttatttgcatgtacttcagataatgtgaattatcttgtgtatcccatccccacttatggtacnttgcttttacaa

SEQ ID NO: 330 - protein, 263 aa, Zea mays
MAAASSMALSSPSLAGKAVKLGPSAPEVGRVSMRKTVTKQVSSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLVHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 331 - DNA, 1149 bp, Zea mays
  CDS (90)..(830)
  misc_feature (68)..(68): n is a, g, c or t
ccggcccggccgggagcaagacaacaaacccacttctgactgaccactgtgccgcgccgtggtcaccnggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcttggccaagaacggcgtcaagttcggcgaggcggtgtggttcaaggccggcgcgcagatcttctcggagggcgggctggactacctggggaaccccaacctggtgctcatgggcttcgtcgagggctaccgcgtcggcggcggcccgctcggggaagggctcgacaaggggtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagacccatccattcgtccgtccgtccgtccgtccgtcgagtgaacagtgtggtcttccctgtactctacttgttcagatcgtaggcgtgtagtagttgcaccagccggcgtatgctcatgatcgatgtgtgtgctcatcaatcaatgtcaatggctgcctgctgtaagcggtcgatgtaaactaagcacagacgcatgtatcgtcatcagtggatgaatcaatctatcgatggcctgtgccattcatttttgaatcgatcaaaaaaaaaaaaaaaaaagcggcc

SEQ ID NO: 332 - protein, 246 aa, Zea mays
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVLMGFVEGYRVGGGPLGEGLDKGYPGGAFDPLGLADDPDTAAELKVKELKNGRLAMFSMFGFFVQAIVTGKGPIENLFDHVADPVANNAWAYATNFVPGN

SEQ ID NO: 333 - DNA, 1149 bp, Zea mays; identical to SEQ ID NO: 331
  CDS (90)..(830)
  misc_feature (68)..(68): n is a, g, c or t

SEQ ID NO: 334 - protein, 246 aa, Zea mays; identical to SEQ ID NO: 332

SEQ ID NO: 335 - DNA, 783 bp, Zea mays
  CDS (1)..(783)
atggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttcccggagatcctggccaagaacggcgtcaagttcggcgaggcggtgtggttcaaggccggcgcgcagatcttctcggagggcgggctggactacctggggaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaa

SEQ ID NO: 336 - protein, 260 aa, Zea mays
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 337 - DNA, 1020 bp, Zea mays
  CDS (69)..(863): subsp. mays
  misc_feature (172)..(172): n is a, g, c or t
gacacagccatcacacgcatactgcatacacaacacagagcatcagaaggagctacgatctgatcgacatggctgccgccaccatggctatcacctcccgcgcgctcgtcggcaagccggcggctggcacgagggacgtcttcggcgagggccgcatcaccatgcgcaagancgccgccaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctggactacctcggcaacccgagcctggtccacgcgcagagcatcctggccatctgggcgtgccaggtggtgctcatgggcgccgtcgaggggtaccgcgtcgccggcggcccgctcggagaggtggtcgacccgctgtaccctggcggcagcttcgacccgctcgggctcgccgacgacccggaggcgttcgccgagctcaaggtgaaggagatcaagaacggccgcctcgccatgttctccatgttcggcttcttcgtgcaggctatcgtcaccggcaagggccccctcgagaacctcgccgaccacatcgccgaccccgtcaacaacaacgcctgggcttacgccaccaacttcgtccccggcaagtgagcgagggcatgatgcttgcatgcgtgtaccgtagacgtacgtattcctacgtactgcaggttgcaccagtatttgtgaagggagctttgggagccagagattgtaccgctagtgtatttgtatgcatgctgtggagctgaacaataaaatatgctgt

SEQ ID NO: 338 - protein, 264 aa, Zea mays
  subsp. mays
  misc_feature (35)..(35): The Xaa at location 35 stands for Asn, Ile, Ser, or Thr.
MAAATMAITSRALVGKPAAGTRDVFGEGRITMRKXAAKPKPAASGSPWYGADRVLYLGPLSGSPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLADDPEAFAELKVKEIKNGRLAMFSMFGFFVQAIVTGKGPLENLADHIADPVNNNAWAYATNFVPGK

SEQ ID NO: 339 - DNA, 972 bp, Glycine max
  CDS (64)..(855)
actcaccacttcaaaacactcataacacaaagcacaaagcaaagctcatccttgagttaaaaaatggcagcagcttcttccatggctctctcatccccatccttggctggcaaggccgtgaagctgggcccatcagccccagaagtgggaagggtgagcatgaggaagaccgtcaccaagcaggtctcctcaggaagcccatggtacggcccagaccgagtcaagtacttgggcccattctctggcgagcccccgtcctacctaaccggtgagttcccaggcgactacggctgggacactgctgggctttccgcagacccagaaaccttcgccaagaaccgtgaactcgaagtgatccactccaggtgggccatgctcggagccttgggctgcgtcttcccggagttgctgtcccgcaacggggtgaagttcggagaagccgtgtggttcaaggccgggtcccagatcttcagcgagggtgggctcgactacttgggcaacccaagcctgatccacgcccagagcatcctcgccatctgggccacacaagttatcctaatgggtgccgttgaaggttaccgtattgctggtggccccctcggtgaggtcactgacccaatctacccaggtggcagcttcgacccattgggccttgctgatgacccagaggcttttgctgagcttaaggtgaaggaactcaagaacggacgattggccatgttctctatgtttggcttctttgttcaggccattgtcaccggaaagggtccattggagaacctcgccgatcaccttgctgaccctgtcaacaacaacgcctgggcctatgccaccaacttcgtccccggaaagtgagcgtcaaagaacgaaatgacttttgagagtttttagatttgtgtttggtgaagtacttcagataatgtgaattatcttgtgtatccgaatccaacttaatgttacttgctttttact

SEQ ID NO: 340 - protein, 263 aa, Glycine max
MAAASSMALSSPSLAGKAVKLGPSAPEVGRVSMRKTVTKQVSSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 341 - DNA, 972 bp, Glycine max; identical to SEQ ID NO: 339
  CDS (82)..(855)

SEQ ID NO: 342 - protein, 257 aa, Glycine max
MALSSPSLAGKAVKLGPSAPEVGRVSMRKTVTKQVSSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 343 - DNA, 972 bp, Glycine max; identical to SEQ ID NO: 339
  CDS (160)..(855)

SEQ ID NO: 344 - protein, 231 aa, Glycine max
MRKTVTKQVSSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 345 - DNA, 1046 bp, Glycine max; identical to SEQ ID NO: 325
  CDS (65)..(838)

SEQ ID NO: 346 - protein, 257 aa, Glycine max
MALSSPSLAGKAVKLGPSAPEVGRVSMRKTVTKQASSGSPWYGPDRVKYLGPFSGEPPSYLTGEFPGDYGWDTAGLSADPETFARNRELEVIHSRWAMLGALGCVFPELLSRNGVKFGEAVWFKAGSQIFSEGGLDYLGNPSLVHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 347 - DNA, 1046 bp, Glycine max; identical to SEQ ID NO: 325
  CDS (143)..(838)

SEQ ID NO: 348 - protein, 231 aa, Glycine max
MRKTVTKQASSGSPWYGPDRVKYLGPFSGEPPSYLTGEFPGDYGWDTAGLSADPETFARNRELEVIHSRWAMLGALGCVFPELLSRNGVKFGEAVWFKAGSQIFSEGGLDYLGNPSLVHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 349 - DNA, 980 bp, Triticum aestivum
  CDS (62)..(862)
actctcaccagtcgcaaaaaaaaaaaaacacaaaaactaaaaaagatcaagaaaagttctaatggctgcctcaaccatggctctgtcctcccctgcctttgccggaaaggccgtgaagctctcaccgggagcctccgaggtctttggaaccggccgtgtcaccatgagaaaaaccgtcaaacccaccggtccatctggcagcccatggtacggatccgacagggtcaagtacttgggtccattctccggagagcccccgagctacctcacaggagagttccctggtgactacggatgggacaccgccggtctatccgctgaccccgagacctttgcaaggaaccgtgagctagaagttatccactgcaggtgggccatgctcggagccctaggctgcgttttccctgagctcttggctaggaacggagtgaagttcggagaagctgtttggttcaaggctggttcacagatcttcagcgaaggagggcttgactacttgggcaacccgagcttggttcacgctcaaagcatcttagccatttgggcgactcaggtgatcctcatgggagctgttgagggttacagagtagccggagagggaccattgggagaagcagaggacttgctttacccaggaggcagcttcgacccgctgggtctcgctaccgacccagaggctttcgcggagttgaaggtgaaggagatcaagaacggaaggttggctatgttctctatgtttggattctttgttcaggctattgtaaccggaaagggaccgttggagaatcttgctgaccatttggctgatccagtcaacaacaacgcatgggcctttgccaccaacttcgtccctggaaagtgaatgaattaaaggttattatcatgcgagtgagcagcagcgaaagagattgtttgtatatttgttaaacttcctttgtcgtatctttgtatgatttatcagaaaccgaacctcatttctc

SEQ ID NO: 350 - protein, 266 aa, Triticum aestivum
MAASTMALSSPAFAGKAVKLSPGASEVFGTGRVTMRKTVKPTGPSGSPWYGSDRVKYLGPFSGEPPSYLTGEFPGDYGWDTAGLSADPETFARNRELEVIHCRWAMLGALGCVFPELLARNGVKFGEAVWFKAGSQIFSEGGLDYLGNPSLVHAQSILAIWATQVILMGAVEGYRVAGEGPLGEAEDLLYPGGSFDPLGLATDPEAFAELKVKEIKNGRLAMFSMFGFFVQAIVTGKGPLENLADHLADPVNNNAWAFATNFVPGK

SEQ ID NO: 351 - DNA, 980 bp, Triticum aestivum; identical to SEQ ID NO: 349
  CDS (77)..(862)

SEQ ID NO: 352 - protein, 261 aa, Triticum aestivum
MALSSPAFAGKAVKLSPGASEVFGTGRVTMRKTVKPTGPSGSPWYGSDRVKYLGPFSGEPPSYLTGEFPGDYGWDTAGLSADPETFARNRELEVIHCRWAMLGALGCVFPELLARNGVKFGEAVWFKAGSQIFSEGGLDYLGNPSLVHAQSILAIWATQVILMGAVEGYRVAGEGPLGEAEDLLYPGGSFDPLGLATDPEAFAELKVKEIKNGRLAMFSMFGFFVQAIVTGKGPLENLADHLADPVNNNAWAFATNFVPGK

SEQ ID NO: 353 - DNA, 980 bp, Triticum aestivum; identical to SEQ ID NO: 349
  CDS (164)..(862)

SEQ ID NO: 354 - protein, 232 aa, Triticum aestivum
MRKTVKPTGPSGSPWYGSDRVKYLGPFSGEPPSYLTGEFPGDYGWDTAGLSADPETFARNRELEVIHCRWAMLGALGCVFPELLARNGVKFGEAVWFKAGSQIFSEGGLDYLGNPSLVHAQSILAIWATQVILMGAVEGYRVAGEGPLGEAEDLLYPGGSFDPLGLATDPEAFAELKVKEIKNGRLAMFSMFGFFVQAIVTGKGPLENLADHLADPVNNNAWAFATNFVPGK

SEQ ID NO: 355 - DNA, 976 bp, Triticum aestivum
  CDS (81)..(887)
ccaccactcactgagaggcacccagcagcagcagccggctaggccaccgtacgtacggactccgatccggagcagcaggcatggcatccaccatcatggccgccgcctcccgcgccgtcgtcgccaagacgccgttcctcagcggccagggccgcgccgcaggcgccagccccctgcgcgacatcgccgccgcggccaacggcagaatcaccatgggcaacgacttgtggtacggcccggaccgcgtcaagtacctggggcccttctccgcgcagacgccgtcctacctgaacggcgagttcccgggcgactacggctgggacaccgccgggctttccgccgacccggaggcgttcgctaggaacagggcgctggaggtgatccacgggcggtgggcgatgctcggcgctcttgggtgcgtcttccccgaggtgctccagaagtgggtgggcgtcgagttcaaggagcccgtctggttcaaggccggctcgcagatcttctccgagggtggcctcgactaccttgggaaccccaacctcgtccacgcgcagagcatccttgccgtgctgggcttccaggtccttctcatgggcctggtcgaagggttccgcatcaatggtctcgacggtgtcggcgagggcaacgacctctaccccggcggccagtacttcgacccgctcggccttgccgacgaccctgtcaccttcgctgagctcaaggtgaaggagatcaagaatggccgtctcgccatgttctccatgtttgggttcttcgtccaagctatcgtcaccggcaagggcccattggagaacctgttcgaccacctcgacgaccctgtcgccaacaatgcatgggttttcgccaccaagtttgcgcctggatcttaggctggccgacgttgccattgtaaagtgtaaactactcccatgtgtgtgtgtgtgtgtgcaaatagcaacgaatggtcgatgtgatctcg

SEQ ID NO: 356 - protein, 268 aa, Triticum aestivum
MASTIMAAASRAVVAKTPFLSGQGRAAGASPLRDIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 357 - DNA, 976 bp, Triticum aestivum; identical to SEQ ID NO: 355
  CDS (96)..(887)

SEQ ID NO: 358 - protein, 263 aa, Triticum aestivum
MAAASRAVVAKTPFLSGQGRAAGASPLRDIAAAANGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 359 - DNA, 801 bp, Zea mays
  CDS (1)..(801): subsp. mays
atggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccggcggcccgctcggcgaggtcgtcgacccgctctatcccggcggcagcttcgacccgctcggcctcgccgacgaccccgaggccttcgctgagctcaaggtgaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtga

SEQ ID NO: 360 - protein, 266 aa, Zea mays
  subsp. mays
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHIADPVNNNAWAYATNFVPGK

SEQ ID NO: 361 - DNA, 786 bp, Zea mays
  CDS (1)..(786): subsp. mays
atggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccggcggcccgctcggcgaggtcgtcgacccgctctatcccggcggcagcttcgacccgctcggcctcgccgacgaccccgaggccttcgctgagctcaaggtgaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtga

SEQ ID NO: 362 - protein, 261 aa, Zea mays
  subsp. mays
MALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHIADPVNNNAWAYATNFVPGK

SEQ ID NO: 363 - DNA, 705 bp, Zea mays
  CDS (1)..(705): subsp. mays
atgcgcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagctgctcgcccgcaacggcgtcaagttcggcgaggccgtgtggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccggcggcccgctcggcgaggtcgtcgacccgctctatcccggcggcagcttcgacccgctcggcctcgccgacgaccccgaggccttcgctgagctcaaggtgaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtga

SEQ ID NO: 364 - protein, 234 aa, Zea mays
  subsp. mays
MRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHIADPVNNNAWAYATNFVPGK

SEQ ID NO: 365 - DNA, 991 bp, Zea mays
  CDS (170)..(859): subsp. mays
gataactcacactctctcttcaatcctttcctttcattgtagttaaacaaagattacgattatggccacatcagctatccaacaatcctccttcgccggccaaacggctctcaagccctccagcgacctcatccaaaaggtgggcgtcttgggcggtggccgtgtgaccatgcgtcgtaccgtcaagtctactccccaaagcatttggtatggaccagaccgtcccaagtacttgggaccattctcggagaacacaccgtcttacttaactggagaataccccggagactacggttgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggctctcagattttctcagaaggaggtcttgattacctcggaaaccctaacttgatccacgcgcaaagcatcttagccatttgggctgttcaagttgtgctcatggggttcattgaaggctacagaatcggaggtggaccactcggagaaggacttgacccgctttaccccggaggtgcgttcgacccattgaacttggctgaggatccagaggctttctctgagctgaaggtgaaggagctcaagaacggtcgtcttgccatgttctctatgtttggattctttgtccaagccattgttactggtaaaggccccattgagaacttgtttgatcatttggctgatcctgtggctaacaacgcctggtcttacgctactaactttgtccccggaaagtaattatcttttatgtatttgcttaataatctctccgctttgtaaacttgtgattgtgtaatattgacgtttgatgtgaatttggcacttaatgatgaaaaaaaaaaaaaaaaaaaactcgagggggggcccggt

SEQ ID NO: 366 - protein, 229 aa, Zea mays
  subsp. mays
MRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWAVQVVLMGFIEGYRIGGGPLGEGLDPLYPGGAFDPLNLAEDPEAFSELKVKELKNGRLAMFSMFGFFVQAIVTGKGPIENLFDHLADPVANNAWSYATNFVPGK

SEQ ID NO: 367 - DNA, 1010 bp, Zea mays
  CDS (65)..(862): subsp. mays
acagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcagcttcgacccgctcggcctcgccgacgaccctgaggccttcgcggagctcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgagggggtggaggcgccaccgcccaccggccaccgctgcggatatctaggtgttcggatgcacgtgagcgcgcactggttccagtttgtaccatgatgtaaattacttaccgtaccagggttcaatcggcaaggaagaattgttgtgttc

SEQ ID NO: 368 - protein, 265 aa, Zea mays
  subsp. mays
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEGYRVAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 369 - DNA, 1010 bp, Zea mays; identical to SEQ ID NO: 367
  CDS (80)..(862): subsp. mays

SEQ ID NO: 370 - protein, 260 aa, Zea mays
  subsp. mays
MALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEGYRVAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 371 - DNA, 847 bp, Brassica napus
  CDS (8)..(811)
  misc_feature (7)..(7): n is a, g, c or t
cacttcnatggcctcttcaacaatggctctctcctcccctgccttcgctggaaaggccgtgaagctttctcctgcagcatcagaagtccttggaagcggccgtgtgacaatgaggaagaccgtcgccaagccaaagggacaatcaggcagcccatggtacggtttcgaaagagtcaagtacttgggtccattctctggcgagccaccgagctaccttaccggagagttcccaggagactacggatgggacaccgcaggcctctcagccgatcccgagacattcgcaaggaaccgtgagctagaagttatccactgcaggtgggccatgcttggagccctaggctgtgtcttcccggagttgttggctaggaacggagtcaagttcggagaggcggtttggttcaaggccggctcacagatcttcagcgaaggaggacttgactacttgggcaaccccggcttagtccacgctcagagcatcttagccatttgggccactcaggtgatcctcatgggagctgttgagggttacagagtcgccggagagggaccattgggagaagcagaggacttgctatacccaggaggcagcttcgacccattgggccttgctaccgacccagaggctttcgccgagttgaaggtgaaggagatcaagaacgggacattggctatgttctctatgtttggattctttgttcaagccattgtcactggtaagggaccgttggagaaccttgctgaccatttggctgatccagtcaacaacaacgcttgggccttcgccaccaacttcgttcccggaaagtgagcgaagttttattttgtaatttgcttcagtcttttt

SEQ ID NO: 372 - protein, 267 aa, Brassica napus
MASSTMALSSPAFAGKAVKLSPAASEVLGSGRVTMRKTVAKPKGQSGSPWYGFERVKYLGPFSGEPPSYLTGEFPGDYGWDTAGLSADPETFARNRELEVIHCRWAMLGALGCVFPELLARNGVKFGEAVWFKAGSQIFSEGGLDYLGNPGLVHAQSILAIWATQVILMGAVEGYRVAGEGPLGEAEDLLYPGGSFDPLGLATDPEAFAELKVKEIKNGTLAMFSMFGFFVQAIVTGKGPLENLADHLADPVNNNAWAFATNFVPGK

SEQ ID NO: 373 - DNA, 1190 bp, Zea mays
  CDS (72)..(866)
gcacgagcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgccggtggcccgctcggggaggtggtcgacccgctgtaccccggcggcagcttcgacccgctcgggctcgccgacgacccggaggcgttcgcggagctcaaggtcaaggagatcaagaacggccgcctcgccatgttctccatgttcggcttcttcgtgcaggccatcgtcaccggcaagggtcccgttgagaacctcgccgaccacctcgctgaccctgtcaacaacaacgcctgggcctacgctaccaacttcgtccccggcaagtgagcgagggcatatacatacttgtatgcgtgtaccgtagacatacgtattcgtatatgtactgcaggagatgtaccagtatttgtgaagaagggagcatgggctcagagattgtaccagtagtgtacgtatttgcatgcatgctttggaaaaaaaaaaaaaaaaaaaaaaaaaaaaaaaaaaaaaaaaaaaaaaaacctcgaatttgccaccttcttgctgttttaaaaatattttatcacttatatgctgcattaggtggtaggagttgaatggttaaacctttgctgcataacttccttgaattattgagtatcaaggatgata

SEQ ID NO: 374 - protein, 264 aa, Zea mays
MAAATMALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKEIKNGRLAMFSMFGFFVQAIVTGKGPVENLADHLADPVNNNAWAYATNFVPGK

SEQ ID NO: 375 - DNA, 1190 bp, Zea mays; identical to SEQ ID NO: 373
  CDS (72)..(866)

SEQ ID NO: 376 - protein, 264 aa, Zea mays; identical to SEQ ID NO: 374

SEQ ID NO: 377 - DNA, 798 bp, Arabidopsis thaliana
  CDS (1)..(798)
atggccacatcagctatccaacaatcctccttcgccggccaaacggctctcaagccctccagcgacctcatccaaaaggtgggcgtcttgggcggtggccgtgtgaccatgcgtcgtaccgtcaagtctactccccaaagcatctggtatggaccagaccgtcccaagtacttgggaccattctcggagaacacaccgtcttacttaactggagaataccccggagactacggctgggacaccgctggactctcggctgacccggagacattcgctaagaaccgtgagcttgaagtaatccacagcagatgggctatgttgggtgctctcggatgcacattccctgaaattctctccaagaacggtgttaaattcggagaagccgtgtggttcaaggcaggctctcagattttctcagaaggaggtcttgattacctcggaaaccctaacttgatccacgcgcaaagcatcttagccatctgggctgttcaagttgtgctcatggggttcattgaaggctacagaatcggaggtggaccactcggagaaggacttgacccgctttatcccggaggtgcgttcgacccattgaacttggctgaggatccagaggctttctctgagctgaaggtgaaggagctcaagaacggtcgtcttgccatgttctctatgtttggattctttgtccaagccattgttactggtaaaggtcccattgagaacttatttgatcatttggctgatcctgtggctaacaacgcctggtcttacgctactaactttgtccccggaaagtaa

SEQ ID NO: 378 - protein, 265 aa, Arabidopsis thaliana
MATSAIQQSSFAGQTALKPSSDLIQKVGVLGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWAVQVVLMGFIEGYRIGGGPLGEGLDPLYPGGAFDPLNLAEDPEAFSELKVKELKNGRLAMFSMFGFFVQAIVTGKGPIENLFDHLADPVANNAWSYATNFVPGK

SEQ ID NO: 379 - DNA, 798 bp, Arabidopsis thaliana
  CDS (1)..(798)
atggcaacatcagctatccagcaatcctccttcgccggccaaacggctctcaagccctccaacgaactcctccgcaaggttggtgtatccggtggtggccgtgtgaccatgcgtcgtaccgtcaagtctactcctcaaagcatctggtacggaccagaccgtcccaagtacttaggaccattctcggagaatacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggttctcagattttctcagaaggaggtcttgattacctcggaaaccctaacttgatccacgcgcaaagcatcttagccatctgggctgttcaagttgtgctcatggggttcattgaaggctacagaatcggaggtggacctctcggagaagggcttgacccgctttaccccggaggtgcgttcgacccattgaacttggctgaggatccagaggctttctctgagctgaaggtgaaggagcttaagaacggtcgtcttgccatgttctctatgtttggattctttgtccaagccattgttactggtaaaggtcccattgagaacttatttgatcatttggctgatcctgtggctaacaacgcctggtcttacgctactaactttgtccccggaaattaa

SEQ ID NO: 380 - protein, 265 aa, Arabidopsis thaliana [sequence omitted]

SEQ ID NO: 381 - DNA, 801 bp, Arabidopsis thaliana
  CDS (1)..(801)
atggccacttcagcaatccaacactcttctttcgctggccaaacgaccctaaagccatccaacgatctcctccgcaaaatcggagcctccaatggcggtggccgcatcatcatgcgtcgtaccgtcaagtctactcctcagagcatctggtacggaccagaccgtcccaaatacctaggaccattttccgaaaacacaccatcatacctaaccggagaataccctggagactacggttgggacaccgctggtctctcagccgatccagaaacattcgcaaagaatcgtgagctcgaagtgatccacagtagatgggcaatgttgggagctttaggctgcaccttccctgaaattctctcaaaaaacggagtcaaattcggtgaagccgtgtggttcaaggcaggatctcaaatcttctcagaaggagggcttgactacctcggaaaccctaacttgatccacgcgcaaagcatattagctatatgggcgtgtcaagttgtgctaatgggattcattgaagggtacagaatcggaggtggtcctcttggggaagggcttgacccgctttacccgggcggggccttcgacccgttgaacttagcggaggatccagaagcgttttcagagttgaaagtgaaggagcttaaaaacggtcgtcttgctatgttctcaatgtttggattctttgtccaagccatagttaccggtaaaggtccgatcgaaaatctgttcgatcacattgcagaccctgtggctaacaatgcttgggcttacgccaccaacttcgtccccggaaaatag

SEQ ID NO: 382 - protein, 266 aa, Arabidopsis thaliana
MATSAIQHSSFAGQTTLKPSNDLLRKIGASNGGGRIIMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGFIEGYRIGGGPLGEGLDPLYPGGAFDPLNLAEDPEAFSELKVKELKNGRLAMFSMFGFFVQAIVTGKGPIENLFDHIADPVANNAWAYATNFVPGK

SEQ ID NO: 383 - DNA, 756 bp, Arabidopsis thaliana
  CDS (1)..(756)
atggcttcctcaaccatggctttgtcctcccctgccttcgccggaaaggctgtgaagcctgccgcatcagatgtcctcggaagcggccgtgtgaccatgaggaagactgtcgccaagccaaagggtccatcaggcagcccatggtacggatctgaccgagtcaagtacttgggtccattctccggcgagcccccgagctaccttaccggtgagttccccggtgactacggatgggacaccgctggtctatccgccgacccagagaccttcgccaggaaccgtgagctagaagttatccacagcagatgggccatgctcggagccctaggctgcgttttccctgagctattggctaggaacggagtgaagttcggagaagcggtttggttcaaggccggttcacagatcttcagcgacggaggattggactacttgggcaacccgagcttggtccacgctcagactgttgaaggctacagagtcgccggagatggtccattgggagaagcagaggacttgctttacccaggtggcagcttcgacccattgggcctcgctactgaccccgaggctttcgcagagttgaaggtgaaggagctcaagaacggaaggttggctatgttctctatgtttggattcttcgttcaagccatcgtcaccggaaagggacctttggagaacctcgccgaccatttggccgacccagtcaacaacaacgcttgggccttcgccaccaacttcgtccccggaaagtga

SEQ ID NO: 384 - protein, 251 aa, Arabidopsis thaliana
MASSTMALSSPAFAGKAVKPAASDVLGSGRVTMRKTVAKPKGPSGSPWYGSDRVKYLGPFSGEPPSYLTGEFPGDYGWDTAGLSADPETFARNRELEVIHSRWAMLGALGCVFPELLARNGVKFGEAVWFKAGSQIFSDGGLDYLGNPSLVHAQTVEGYRVAGDGPLGEAEDLLYPGGSFDPLGLATDPEAFAELKVKELKNGRLAMFSMFGFFVQAIVTGKGPLENLADHLADPVNNNAWAFATNFVPGK

SEQ ID NO: 385 - DNA, 798 bp, Oryza sativa
  CDS (1)..(798): Japonica cultivar group
atggcggcgtccaccatggcactctcctcccctgccgccctcgccggcaaggcggtcgccaatgccaaggtgttcggcgagggccgcgtcacgatgcgcaagtcggcggccaagcccaagcccgccgcggcgtcggggagcccgtggtacggcgccgaccgcgtgctctacctcggcccgctctccggcgagccgccgtcctacctcaccggcgagttccccggcgactacggctgggacaccgccgggctgtcggccgacccggagacgttcgccaagaaccgggagctggaggtgatccactgccggtgggccatgctgggcgcgctcggctgcgtcttcccggagctcctcgcccgcaacggcgtgaagttcggcgaggccgtgtggttcaaggcggggtcccagatcttcagcgagggggggctcgactacctcggcaaccccagcctgatccacgcgcagagcatcctggcgatctggggttgccaggtcgtgctcatgggcgccgtcgaggggtaccgcgtcgccggcggcccgctcggcgaggtcgtcgacccgctctaccccggcggcagcttcgacccgctcggcctcgccgacgaccccgaggcgttcgccgagctcaaggtgaaggagatcaagaacggccgcctcgccatgttctccatgttcgggttcttcgtccaggccatcgtcaccggcaaggggccactggagaacctggccgaccacctcgccgaccccgtcaacaacaacgcatgggcctacgccaccaacttcgtccccggcaagtga

SEQ ID NO: 386 - protein, 265 aa, Oryza sativa
  Japonica cultivar group
MAASTMALSSPAALAGKAVANAKVFGEGRVTMRKSAAKPKPAAASGSPWYGADRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWGCQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 387 - DNA, 789 bp, Oryza sativa
  CDS (1)..(789): Japonica cultivar group
atggccgccgccaccatggccctctcgtccccggcgctggccggcaaggccgccgcgaaggtgttcggcgaggggcgcatcaccatgcgcaagtcggcggcgaagcccaagcccgccgcgtcggggagcccgtggtacggcgccgaccgcgtgctctacctcggcccgctctccggcgagccgccgagctacctgaccggcgagttccccggcgactacgggtgggacaccgcggggctctccgccgacccggagacgttcgccaagaaccgggagctggaggtgatccactccaggtgggcgatgctcggcgcgctgggctgcgtgttcccggagctcctcgcccgcaacggcgtcaagttcggcgaggcggtgtggttcaaggcggggtcgcagatcttcagcgagggcgggctcgactacctcggcaacccgagcctgatccacgcgcagagcatcctcgccatctgggcggtccaggtggtgctcatgggcgccgtcgaggggtaccgcatcgccggcgggccgctcggcgaggtcgtcgacccgctctaccccggcggcagcttcgacccgctcggcctcgccgacgacccggaggccttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcctacgccaccaacttcgtccccggcaagttctga

SEQ ID NO: 388 - protein, 262 aa, Oryza sativa
  Japonica cultivar group
MAAATMALSSPALAGKAAAKVFGEGRITMRKSAAKPKPAASGSPWYGADRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPLGLADDPEAFAELKVKEIKNGRLAMFSMFGFFVQAIVTGKGPLENLADHLADPVNNNAWAYATNFVPGKF

SEQ ID NO: 389 - DNA, 798 bp, Oryza sativa
  CDS (1)..(798)
atggcggcgtccaccatggcactctcctcccctgccgccctcgccggcaaggcggtcgccaatgccaaggtgttcggcgagggccgcgtcacgatgcgcaagtcggcggccaagcccaagcccgccgcggcgtcggggagcccgtggtacggcgccgaccgcgtgctctacctcggcccgctctccggcgagccgccgtcctacctcaccggcgagttctccggcgactacggctgggacaccgccgggctgtcggccgacccggagacgttcgccaagaaccgggagctggaggtgatccactgccggtgggccatgctgggcgcgctcggctgcgtcttcccggagctcctcgcccgcaacggcgtgaagttcggcgaggccgtgtggttcaaggcggggtcccagatcttcagcgagggggggctcgactacctcggcaaccccagcctgatccacgcgcagagcatcctggcgatttggggttgccaggtcgtgttcatgggcgccgtcgaggggtaccgcgtcgccggcggcccgctcggggaggttgtcgacccgctctaccccggcggcagtttagacccgctcggcctcgccgacgaccccgaggcgttcgccgagctcaaggtgaaggagatcaagaacggccgcctcgccatgttatccatgttcgggttttttgtccaggccatcgtcaccggcaaggggccactggagaacatcacagaccacctcgccgaccccgtcaacaacaacgcatgggcctacgccaccaactttgtccccggcaagtga

SEQ ID NO: 390 - protein, 265 aa, Oryza sativa
MAASTMALSSPAALAGKAVANAKVFGEGRVTMRKSAAKPKPAAASGSPWYGADRVLYLGPLSGEPPSYLTGEFSGDYGWDTAGLSADPETFAKNRELEVIHCRWAMLGALGCVFPELLARNGVKFGEAVWFKAGSQIFSEGGLDYLGNPSLIHAQSILAIWGCQVVFMGAVEGYRVAGGPLGEVVDPLYPGGSLDPLGLADDPEAFAELKVKEIKNGRLAMLSMFGFFVQAIVTGKGPLENITDHLADPVNNNAWAYATNFVPGK

SEQ ID NO: 391 - DNA, 801 bp, Triticum aestivum
  CDS (1)..(801)
atggcggcagccaccatgtccctctcctcctcgacctttgccggcaaggcggtgaagaatgtaccatctttggctctcttgggcgaggcccgcgtcaccatgcgcaagaccgcagcaaaggcaaagcaggtttcctccggcagcccatggtacggtgctgaccgtgtgctctacctcggcccactctccggtgagcctccgagctacctgaccggtgagttccctggcgactatgggtgggacactgctggactttcggctgacccggagaccttctccaagaaccgggagctggaggtgatccactgtcgctgggccatgcttggggcacttggttgtgtcttccctgagttgctcgcccgcaacggcgtcaagtttggcgaggccgtttggttcaaggccggctcccagatctttagtgagggtggtctcgactacctcggcaaccccagcctagtgcacgcacaaagcatcctagctatttgggcatgccaggtcgtgctcatgggtgccgtcgaggggtaccgtgttgccggcggcccactcggtgagatcgttgacccactctacccaggcggtagcttcgaccctcttggcttggccgaagaccctgaggcattcgccgagctcaaggtgaaggagatcaagaacggtcgccttgccatgttctcaatgtttggcttctttgtccaagctatcgtcacgggcaagggcccacttgagaacctcgctgaccacatcgccgaccccgtcaacaacaatgcatgggcattcgccaccaactttgtccccggcaagtaa

SEQ ID NO: 392 - protein, 266 aa, Triticum aestivum
MAAATMSLSSSTFAGKAVKNVPSLALLGEARVTMRKTAAKAKQVSSGSPWYGADRVLYLGPLSGEPPSYLTGEFPGDYGWDTAGLSADPETFSKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGKGPLENLADHIADPVNNNAWAFATNFVPGK

SEQ ID NO: 393 - DNA, 795 bp, Beta vulgaris subsp
  CDS (1)..(795)
atggcaacctcaactatccaacaatctgcatttgctgggcagaccatcttgaagccccagaatgagctcgtccgcaagttcggtggcaacggaggccgtgcttcgatgcgtcgcactgtcaagagcgcccctcaaagcatatggtacggtcctgaccgtcccaagtatttgggtcccttctcagagcagaccccatcataccttactggagagttccctggtgactacggttgggacactgctggactatcagcagaccctgaaaccttcgctaagaaccgtgagctcgaggtgatccactctaggtgggcaatgcttggtgccctgggatgtgtattccctgaaatcctgtctaaaaacggtgtcaaattcggcgaagctgtgtggtttaaggctggatcacaaatcttccaggaaggtggacttgactacctaggcaacccaaacctgatccatgcccaaagcatccttgctatctgggctagccaagtagtccttatgggtttgatcgagggctaccgtgttggtggtgggccattgggtgaagggctcgacaagctctacccaggtggagcttttgacccacttggtttggcagatgatccagaggcctttgctgagctcaaggttaaggagctcaagaacggaagattggctatgttctccatgttcgggttcttcgtgcaagctattgttactggaaagggtcccattgagaacctctcagaccaccttgctgacccagtggctaacaatgcctgggcctttgccaccaacttcgttcctggaaagtga

SEQ ID NO: 394 - protein, 264 aa, Beta vulgaris subsp
MATSTIQQSAFAGQTILKPQNELVRKFGGNGGRASMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFQEGGLDYLGNPNLIHAQSILAIWASQVVLMGLIEGYRVGGGPLGEGLDKLYPGGAFDPLGLADDPEAFAELKVKELKNGRLAMFSMFGFFVQAIVTGKGPIENLSDHLADPVANNAWAFATNFVPGK

SEQ ID NO: 395 - DNA, 798 bp, Nicotiana sylvestris
  CDS (1)..(798)
atggcagctgctacaatggctctttcttccccttcttttgctggacaggcagtgaaactctccccatctgcctcagaaatcactggaaatggaagggtgtccatgagaaagactgccgccaaacccgtctcttctagcagcccatggtatggcccagaccgtgttaagtacttgggcccattctccggtgagtctccaagctacttgaccagtgaattccctggtgattatgggtgggatactgctggactttcagcagatccagaaacctttgccaagaaccgtgaactcgaggtgatccactgcagatgggctatgcttggtgctcttggatgtgtcttccctgagctcttggctcgtaacggtgtcaagtttggcgaagctgtctggttcaaggctggatcccaaatctttagcgagggtggacttgactacttgggcaacccaagcttggtccatgcacaaagcatcttggccatctgggcttgccaagttatcttgatgggagccgttgagggttaccgtgttgctggtgggcctcttggtgaggttgtcgacccactctaccctggtggcagctttgacccactgggccttgctgaggatccagaggcattcgccgagctcaaggtaaaagagattaagaacggaagactcgccatgttctctatgttcggattctttgttcaagccattgttaccggaaagggcccattagagaaccttgctgaccaccttgcagacccagttaacaacaatgcttgggcgtacgccacaaactttgtccccggaaaatga

SEQ ID NO: 396 - protein, 265 aa, Nicotiana sylvestris
MAAATMALSSPSFAGQAVKLSPSASEITGNGRVSMRKTAAKPVSSSSPWYGPDRVKYLGPFSGESPSYLTSEFPGDYGWDTAGLSADPETFAKNRELEVIHCRWAMLGALGCVFPELLARNGVKFGEAVWFKAGSQIFSEGGLDYLGNPSLVHAQSILAIWACQVILMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 397 - DNA, 798 bp, Nicotiana sylvestris
  CDS (1)..(798)
atggcagctgctacaatggctctttcttccccttctttcgctggacaagcagtgaaactctccccatctgcctcagaaatcactggaaatggaagggtgtctatgagaaagactgtcgccaaacccgtcgcatctagcagcccatggtacggtccagaccgtgttaagtacttgggcccattttctggtgagtctccaagctatttgactggtgaattccctggtgactatgggtgggatactgctggactttcagccgacccagaaacttttgccaagaaccgtgaactcgaggtgattcactgcagatgggctatgcttggtgctcttggatgtgttttccccgagctcttggcccgtaatggcgtcaagtttggtgaggctgtatggttcaaggctggatcacaaatctttagcgagggtggacttgactacttgggcaatccaagcttgatccacgcacaaagcatcttggctatctgggcttgccaagttatcttgatgggagccgttgagggttaccgtgttgctggtgggcctcttggtgaggttgtcgacccactctaccctggtggcagctttgacccactaggccttgctgaggacccagaggcattcgctgagctcaaagtaaaggagatcaagaatggcaggcttgccatgttctctatgttcggattctttgttcaggccattgttactggaaaaggtccattggagaaccttgctgaccatcttgctgacccagttaacaacaacgcctggtcctacgccacaaactttgtccctggaaaatga

SEQ ID NO: 398 - protein, 265 aa, Nicotiana sylvestris
MAAATMALSSPSFAGQAVKLSPSASEITGNGRVSMRKTVAKPVASSSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVILMGAVEGYRVAGGPLGEVVDPLYPGGSFDPLGLAEDPEAFAELKVKEIKNGRLAMFSMFGFFVQAIVTGKGPLENLADHLADPVNNNAWSYATNFVPGK

SEQ ID NO: 399 - DNA, 798 bp, Nicotiana sylvestris
  CDS (1)..(798)
atggcagcttctacaatggctctttcttccccttcttttgctggacaggcagtgaaactctccccatctgccccagaaattactggaaatggaagggtgtccatgagaaagactgtcgccaaacccgtcgcatctagcagcccatggtacggtccagaccgtgttaagtacttgggcccattctccggtgagtccccaagctacttgaccggtgaatttcccggtgactatgggtgggatactgctggactttcagcagatccagaaacctttgccaagaaccgtgagctcgaggtgatccactgcagatgggctatgcttggtgctcttggatgtgtcttccccgagctcttggcccgtaacggtgttaagtttggcgaggctgtgtggttcaaggccggatcccaaatcttcagcgatggtggacttgactatttgggcaacccaagcttgatccacgcacaaagcatcttggcaatatgggcttgccaggttatcttgatgggagccgttgagggataccgtgtagctggtggacctcttggtgaggttgtcgacccactctaccctggtggtagctttgacccattggggcttgctgatgacccagaggcatttgctgagctcaaagtaaaggagatcaagaatgggagacttgccatgttctctatgttcggattctttgttcaggccattgttaccggaaagggcccattggagaaccttgctgaccaccttgcagaccctgttaacaacaacgcctggtcctatgccacaaactttgtccccggaaaatga

SEQ ID NO: 400 - protein, 265 aa, Nicotiana sylvestris
MAASTMALSSPSFAGQAVKLSPSAPEITGNGRVSMRKTVAKPVASSSPWYGPDRVKYLGPFSGESPSYLTGEFPGDYGWDTAGLSADPETFAKNRELEVIHCRWAMLGALGCVFPELLARNGVKFGEAVWFKAGSQIFSDGGLDYLGNPSLIHAQSILAIWACQVILMGAVEGYRVAGGPLGEVVDPLYPGGSFDPLGLADDPEAFAELKVKEIKNGRLAMFSMFGFFVQAIVTGKGPLENLADHLADPVNNNAWSYATNFVPGK

SEQ ID NO: 401 - DNA, 798 bp, Nicotiana sylvestris
  CDS (1)..(798)
atggctgcttctacaatggctctttcttccccttcttttgctggacaggcagtgaaactctccccatctgcctcagaaatcactggaaatggaagggtgtccatgagaaagaccgtcgccaaacctgtcgcatctagcagcccatggtacggcccagaccgtgttaagtacttgggcccattctccggtgaggccccaagctacttgaccggtgaattcccaggtgattacgggtgggatactgctggactttcagcggatccagaaacctttgccaagaaccgtgaactcgaggtgatccactgcagatgggctatgcttggtgctcttggatgtgtcttccctgagctcttggctcgtaacggtgtcaagtttggcgaagctgtctggttcaaggctggatcccaaatctttagcgagggtggacttgactacttgggcaacccaagcttggtgcatgcacaaagcatcttggccatctgggcttgccaagttatcttgatgggagccgttgagggttaccgtgttgctggtgggcctcttggtgaggttgtcgacccactctaccctggtggcagctttgacccactgggccttgctgaggatccagaggcattcgccgagctcaaggtaaaagagattaagaacggaagactcgccatgttctctatgttcggattctttgttcaagccattgttactggaaagggcccattagagaaccttgctgaccaccttgcagacccagttaacaacaatgcttgggcctacgccacaaactttgtccccggaaaatga

SEQ ID NO: 402 - protein, 265 aa, Nicotiana sylvestris
MAASTMALSSPSFAGQAVKLSPSASEITGNGRVSMRKTVAKPVASSSPWYGPDRVKYLGPFSGEAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVILMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 403 - DNA, 804 bp, Nicotiana sylvestris
  CDS (1)..(804)
atggctgcttctacaatggctctctcttcctcttcttttgccggaaaggcagtgaaactctcaccatcttcctctgaaatcaccggaaatgggaaagttaccatgaggaagactgctagcaaggccaagcctgtctcttctggcagcccatggtacggtcccgaccgtgtcaagtacttgggcccattctctggtgagtctccaagctacttgactggtgagtttccaggtgactatggatgggacactgctggactttcagctgatccagaaacttttgccaagaaccgtgagttggaggtgatccactgcagatgggccatgcttggagctcttggttgtgtcttccccgagctcttggcacgtaacggtgtcaagttcggagaagctgtatggttcaaggctggttcccagattttcagcgagggtggtcttgactacttgggcaacccaagtttggttcacgcacaaagcatcttggctatttgggcttgccaagtcgtattgatgggagctgttgagggttaccgtgttgctggtgggcctcttggtgaggttgttgacccactttaccccggtggtagtttcgatccattgggtcttgctgaagacccagaggctttcgctgagctcaaggtaaaggagatcaagaatggtagacttgctatgttctccatgtttggtttcttcgttcaagctatcgtcaccggaaagggtccattggagaaccttgccgaccatcttgctgacccagttaacaacaacgcttgggcctatgccacaaactttgttcccggaaagtga

SEQ ID NO: 404 - protein, 267 aa, Nicotiana sylvestris
MAASTMALSSSSFAGKAVKLSPSSSEITGNGKVTMRKTASKAKPVSSGSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 405 - DNA, 801 bp, Nicotiana sylvestris
  CDS (1)..(801)
atggcatcttctaccatggctctttcttcatcttttgcaggaaaggcagtaaaactctcaccatcttcctctgaaatcactggaaatgggaaagttaccatgaggaagactgctagcaaagccaagcctgtctcttctggtagcctatggtacggtcctgatcgtgttaagtacttgggcccattctctggtgagtctccaagctacttgactggtgaattccctggtgactacgggtgggacactgctggactttcagctgatccagaaacttttgctaagaaccgtgagttggaggtgatccactgcagatgggcaatgcttggagctcttggttgtgtcttccccgagctcttggcccgtaatggtgttaagtttggcgaggccgtatggttcaaggctggatctcaaattttcagtgaaggtggacttgactacttgggcaacccaagtttggtccacgcacaaagcattttagccatctgggcttgccaagttatattgatgggagccgttgagggttaccgtgttgctggtgggcctcttggtgaggttgttgacccactttaccccggtggcagcttcgatccattgggccttgctgaagatcctgaggcttttgctgagctcaaggtaaaggagatcaagaatggcagacttgccatgttctccatgtttggattctttgttcaggctatcgtcaccggaaaaggtccattggagaaccttgccgaccaccttgctgacccagttaacaacaatgcctgggcatatgccactaactttgttcccggaaagtga

SEQ ID NO: 406 - protein, 266 aa, Nicotiana sylvestris
MASSTMALSSSFAGKAVKLSPSSSEITGNGKVTMRKTASKAKPVSSGSLWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVILMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 407 - DNA, 804 bp, Nicotiana sylvestris
  CDS (1)..(804)
atggcagctgctacaatgtctctttcttccccttcttttgccggaaaggcagtaaaactctcaccatcttcctatgaaatcattggaaatggaaaagtcaccatgagaaagactgttatcaaggctaagcccgtctcctcgggtagcccatggtacggtcctgatcgtgtcaagtatttgggtccattctctggtaactccccaagttacttgactggtgaatttcctggtgattatggttgggatactgctggactttcggccgatccagaaacttttgccaaaaaccgtgagctagaggttattcactgcagatgggccatgcttggagctcttggttgcgtctttcctgagctcttagcccgtaacggtgtcaaattcggtgaagctgtatggttcaaagctggatcacagatttttagtgagggtggacttgactatttgggcaacccaagtttggtccacgcacaaagcatcttggcaatttgggcttgccaagttgtgttgatgggagccgtcgagggttaccgtgttgctggtgggcctcttggtgaggttgttgacccactttaccctggcggtagtttcgatccattgggtcttgcggatgacccggaagcttttgctgagcttaaagtaaaggaaatcaagaatggcagacttgctatgttctccatgtttggattctttgttcaagctatcgtcactggaaagggtccattggagaaccttgctgaccatcttgcagaccccgttaacaataatgcttgggcatatgccacaaacttcgtccccggaaaatga

SEQ ID NO: 408 - protein, 267 aa, Nicotiana sylvestris
MAAATMSLSSPSFAGKAVKLSPSSYEIIGNGKVTMRKTVIKAKPVSSGSPWYGPDRVKYLGPFSGNSPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 409 - DNA, 804 bp, Nicotiana sylvestris
  CDS (1)..(804)
atgactgcctctacaatggctctctcttccccttcttttgctggaaatgcagtgaaactctcaccatcttcctctgagatcactggaaatggaaaagctataatgagaaagactgttaccaaggcgaagccagtctcttctggtagcccatggtatggtcctgatcgtgtcaagtacttgggcccattctctggtgaagcaccaagttacttgactggtgagttccctggtgattatgggtgggacactgctggactttcagctgatccagaaacttttgctaagaaccgtgagctagaggtgattcactgtagatgggctatgcttggagctctcggttgtgtcttccccgaactcttggctcgtaatggtgtcaagttcggtgaagctgtctggttcaaggctggatctcaaattttcagcgagggtggacttgactacttgggcaacccaagtttggtccatgcacaaagcatcttggccatttgggcttgccaagttgtgttgatgggagctattgagggttaccgtgttgctggtggacctcttggtgaggttaccgacccactctaccccggtggtagctttgacccattaggtcttgctgatgacccagaggcttttgctgagctcaaggtaaaggagattaaaaacggtaggcttgctatgttctccatgttcggattcttcgttcaagctattgtcactggaaaaggtccattagagaaccttgttgatcaccttgctgaccccgttaacaacaacgcctgggcctatgccacaaactttgtccccggaaagtaa

SEQ ID NO: 410 - protein, 267 aa, Nicotiana sylvestris
MTASTMALSSPSFAGNAVKLSPSSSEITGNGKAIMRKTVTKAKPVSSGSPWYGPDRVKYLGPFSGEAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAIEGYRVAGGPLGEVTDPLYPGGSFDPLGLADDPEAFAELKVKEIKNGRLAMFSMFGFFVQAIVTGKGPLENLVDHLADPVNNNAWAYATNFVPGK

SEQ ID NO: 411 - DNA, 804 bp, Nicotiana sylvestris
  CDS (1)..(804)
atggcagcttctacaatggctctctcttcctcttcttttgttggaaaggcagtgaaactctcaccatcttcctctgaaatcactggaaatgggaaagttaccatgaggaaaactgctaccaaggccaagcctgtctcttctggcagtccatggtacggccctgaccgtgtcaagtacttgggcccattctctggtgagtccccaagctacttgacgggtgagttccctggtgattatggatgggacactgctggactttcagctgatccagaaacttttgctaagaaccgtgagttggaggtgatccattgcagatgggccatgcttggagctcttggttgtgtcttccccgaactcttggctcgtaacggagtcaagttcggtgaggctgtatggttcaaggctggatcccagattttcagcgaaggtggacttgactacttgggcaacccaagtttggtccatgcacaaagcattttggccatttgggcttgccaagttgtcttgatgggagccgttgaaggttaccgtgttgcaggcgggcctctcggcgaggttgttgacccactttaccctggtggtagtttcgacccattgggtcttgctgaagacccagaggctttcgctgagctcaaggtgaaggaaatcaagaatggtagacttgccatgttctctatgtttggattcttcgtgcaagctatagtcaccggaaagggtccattagagaaccttgctgaccaccttgccgacccagttaacaacaacgcttgggcctatgccacaaattttgttcctggaaagtga

SEQ ID NO: 412 - protein, 267 aa, Nicotiana sylvestris
MAASTMALSSSSFVGKAVKLSPSSSEITGNGKVTMRKTATKAKPVSSGSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 413 - DNA, 801 bp, Medicago sativa
  CDS (1)..(801)
atggccgcatcatccatggctctctcttcaccaaccttggctggcaagccagtcaagctaaccccttcaagccaagaattgggagctgcaaggttcaccatgaggaagtctgctaccaccaagaaagtagcctcctcaggaagcccatggtacggcccagaccgtgttaagtacttaggcccattctctggtgagcccccgtcttacttgactggagagttcccaggtgactacggatgggacactgctggactttctgctgacccagagacattcgccaagaaccgtgaacttgaagtcatccatagcaggtgggctatgttgggagccttgggatgtgttttcccagagcttttgtctcgcaatggtgttaaattcggtgaagctgtatggttcaaggccggatcccagatctttagcgagggtggacttgactacttgggtaacccaagtttggtccatgctcagagcattcttgccatctgggccactcaagttatcttgatgggagccgttgaaggttaccgtattgctggtggacctcttggtgaggttgttgacccactatacccaggaggcagctttgacccattgggcctagctgacgacccagaggctttcgcagagttgaaggttaaggaactcaagaacggcagattagccatgttctctatgttcggattctttgttcaggctattgtgaccggaaagggacctttggagaaccttgctgatcatcttgccgacccagtcaacaacaacgcatgggcctatgccaccaactttgttcccggaaagtga

SEQ ID NO: 414 - protein, 266 aa, Medicago sativa
MAASSMALSSPTLAGKPVKLTPSSQELGAARFTMRKSATTKKVASSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLVHAQSILAIWATQVILMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 415 - DNA, 804 bp, Brassica napus
  CDS (1)..(804)
atggccgcctcaacaatggctctctcctcccctgccttcgccggaaaggccgtcaagctttccccagcagcatcagaagtccttggaagcggccgtgtgacaatgaggaagaccgtagccaagccaaagggcccatcaggcagcccatggtacggatccgagagagtcaagtacttgggcccattctccggcgagccaccgagctaccttaccggagagttcccaggagactacggatgggacaccgcaggtctctcagccgatcccgagacgttcgcgaggaaccgtgagctacaagttatccactgcaggtgggccatgctcggagccctaggctgcgtcttcccggagctgttggccaggaacggagtcaagttcggagaggcggtttggttcaaggccggttcgcagatcttcagcgaaggaggacttgattacttgggaaaccctagcttggttcacgctcagagcatcttggctatttgggctactcaagtgatcttgatgggagccgttgaaggttacagagtcgcaggagatgggccgttgggagaggccgaggacttgctttacccaggtggcagctttgacccgttgggtttggctactgacccagaggccttcgcggagttgaaggtgaaggagatcaagaacggaagattggctatgttctctatgtttggattctttgctcaagctattgtcactggtaagggacctttggagaatcttgctgaccatttggctgatccagttaacaacaatgcatgggcctttgctaccaacttcgttcccggaaagtga

SEQ ID NO: 416 - protein, 267 aa, Brassica napus
MAASTMALSSPAFAGKAVKLSPAASEVLGSGRVTMRKTVAKPKGPSGSPWYGSERVKYLGPFSGEPPSYLTGEFPGDYGWDTAGLSADPETFARNRELQVIHCRWAMLGALGCVFPELLARNGVKFGEAVWFKAGSQIFSEGGLDYLGNPSLVHAQSILAIWATQVILMGAVEGYRVAGDGPLGEAEDLLYPGGSFDPLGLATDPEAFAELKVKEIKNGRLAMFSMFGFFAQAIVTGKGPLENLADHLADPVNNNAWAFATNFVPGK

SEQ ID NO: 417 - DNA, 795 bp, Musa acuminata
  CDS (1)..(795)
atggctacctccgcgctccagcaatcggctttcgccggccagaccgctctgaagcagcagaacgagctcgtccgcagggtcggctcctccagaggccgcttcttcatgcgccgcacgacggcgagcacccccaagagcatctggtacgggccggaccgtcccaagtacttggggcccttctcggagcagacgccgtcgtacctgacgggcgagttcccgggcgactacgggtgggacacggcggggctgtcggcggacccggagacgttcgcgaagaaccgggagctggaggtgatccacgggcggtgggcgatgctgggggcgctggggtgcgtcttcccggagatcctggccaagaacggcgtcaagttcggggaggcggtgtggttcaaggctggggcgcagatcttctcggagggcggcctcgactacctgggcaaccccaacctgatccacgcgcagagcatcctcgccatctgggcctgccaggtggtgctgatgggcttcgtggagggctaccgcgtcggcggcggcccgctgggtgagggcctcgacgccatctaccccggcggcgccttcgaccccctgggcctggccgacgaccccgacgccttcgcggagctcaaggtgaaggagatcaagaacggccggcttgccatgttctccatgttcggcttcttcgtgcaggccatcgtcaccggcaagggccccatcgagaacctctacgaccacctcgccgaccccgtcgccaacaacgcctgggcctacgccaccaacttcgtccccggcaagtga

SEQ ID NO: 418 - protein, 264 aa, Musa acuminata
MATSALQQSAFAGQTALKQQNELVRRVGSSRGRFFMRRTTASTPKSIWYGPDRPKYLGPFSEQTPSYLTGEFPGDYGWDTAGLSADPETFAKNRELEVIHGRWAMLGALGCVFPEILAKNGVKFGEAVWFKAGAQIFSEGGLDYLGNPNLIHAQSILAIWACQVVLMGFVEGYRVGGGPLGEGLDAIYPGGAFDPLGLADDPDAFAELKVKEIKNGRLAMFSMFGFFVQAIVTGKGPIENLYDHLADPVANNAWAYATNFVPGK

SEQ ID NO: 419 - DNA, 804 bp, Musa balbisiana
  CDS (1)..(804)
atggctgccacgatggccctctcctccccatccctcgcggggaaggcggtgaagctcgccccctcggcctccgacgtcctgggggagggcagggtgaccatgcgcaagagcaccgcgaaggccaagcccgcggcggcctccggcagcccctggtacggccccgaccgcgtcaagtacctgggccccttctccggcgagcccccgtcctacctcaccggcgagttccccggcgactacgggtgggacaccgccgggctgtcggccgacccggagaccttcgccaagaaccgggagctggaggtgatccactgcaggtgggccatgctgggcgccctgggctgcgtcttcccggagctgctggcgcgcaacggggtcaagttcggggaggcggtgtggttcaaggcgggcgcccaaatcttcagcgagggcgggctggactacctgggcaaccccagcttgatccacgcccagagcattctggccatctgggcctgccaggtcattctgatgggcgccgtcgaggggtaccgcattgccggcgggccgctgggagaggtgacggacccgctgtaccccggcggcagcttcgacccgctcggcctggccgacgacccggaggcgttcgcggagctgaaggtgaaggagatcaagaacgggaggctggccatgttctccatgttcggcttcttcgtgcaggccatcgtcaccgggaagggtcctttggaaaacctggccgaccacctggcggaccccgtgaacaacaacgcatgggcctacgccaccaacttcgtcccgggcaagtga

SEQ ID NO: 420 - protein, 267 aa, Musa balbisiana
MAATMALSSPSLAGKAVKLAPSASDVLGEGRVTMRKSTAKAKPAAASGSPWYGPDRVKYLGPFSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVILMGAVEGYRIAGGPLGEVTDPLYPGGSFDPLGLADDPEAFAELKVKEIKNGRLAMFSMFGFFVQAIVTGKGPLENLADHLADPVNNNAWAYATNFVPGK

SEQ ID NO: 421 - DNA, 804 bp, Musa balbisiana; identical to SEQ ID NO: 419
  CDS (1)..(804)

SEQ ID NO: 422 - protein, 267 aa, Musa balbisiana; identical to SEQ ID NO: 420

SEQ ID NO: 423 - DNA, 798 bp, Musa acuminata
  CDS (1)..(798)
atggctgcaacaatggccctctcctccccctccttcgccggcaaggccgtgaagcttgccccttccgcctccggcgtcctcggccagggcagggtcaccatgcgcaaggcaggcggcaagccggctgcctcctccggcagcccatggtacggccccgaccgcgtcaagtatttgggccccttatccggcgagcccccatcctacctgaccggcgagttcccaggcgactacgggtgggacaccgctggcctctcggccgatcccgagaccttcgccaagaaccgggagttggaggtgatccactgccggtgggccatgctgggcgcgctggggtgcgtcttcccggagctgctggcccgcaacggggtcaagttcggggaagccgtctggttcaaggcgggggcgcagatctttagcgagggggggctggactacctgggcaacccgagcttgatccacgcgcagagcatcctggccatctgggcctgccaggtgatcctgatgggcgccgtcgaggggtaccgcatcgccggggggcctctgggggaggtgaccgacccgctgtacccgggcggcagcttcgacccgctcggcctcgccgacgacccggaggcgttcgcggagctgaaggtgaaggagatcaagaacgggaggctggccatgttctccatgtttgggttcttcgtgcaggccatcgtgaccgggaaggggccgctggagaacctggccgaccacctggccgaccccgtcaacaacaacgcctgggcctacgccaccaacttcgtgcccggcaagtga

SEQ ID NO: 424 - protein, 265 aa, Musa acuminata
MAATMALSSPSFAGKAVKLAPSASGVLGQGRVTMRKAGGKPAASSGSPWYGPDRVKYLGPLSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVILMGAVEGYRIAGGPLGEVTDPLYPGGSFDPLGLADDPEAFAELKVKEIKNGRLAMFSMFGFFVQAIVTGKGPLENLADHLADPVNNNAWAYATNFVPGK

SEQ ID NO: 425 - DNA, 804 bp, Solanum tuberosum
  CDS (1)..(804)
atggctgcttcatccatggctctttcttcctctactttcgccggtaaggcggtaaaactctcaccatcttcttctgaaatcacaggaaatgggagaattaccatgaggaagagtgttgccaaggccaagcctgcctcctctggtagcccatggtatggtcctgaccgtgttaagtacttgggcccattctctggtgaagccccaagctacttgactggtgagtttcctggtgactacggatgggacactgctggactttcagctgaccctgaaacattcgctaagaaccgtgagcttgaggtgatccactgcagatgggccatgcttggtgctcttggatgtgtcttccctgagcttttggcccgtaatggtgtcaagtttggcgaagctgtatggttcaaggctggatcccaaattttcagcgagggtggacttgactacttgggcaacccaagtttggtccatgcacaaagcatcttggctatctgggcttgccaagttgtgttgatgggagccgttgagggttaccgtattgctggtgggcctcttggtgaggttgttgacccactttaccctggtggtagctttgacccattgggccttgctgatgacccagaggcttttgctgagctcaaggttaaggaaatcaagaatggcagacttgctatgttctctatgtttggattctttgtccaagctattgtcaccggaaagggtccattggagaaccttgccgaccaccttgctgacccagttaacaacaacgcttgggcctttgccacaaactttgttcccggaaagtga

SEQ ID NO: 426 - protein, 267 aa, Solanum tuberosum
MAASSMALSSSTFAGKAVKLSPSSSEITGNGRITMRKSVAKAKPASSGSPWYGPDRVKYLGPFSGEAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRIAGGPLGEVVDPLYPGGSFDPLGLADDPEAFAELKVKEIKNGRLAMFSMFGFFVQAIVTGKGPLENLADHLADPVNNNAWAFATNFVPGK

SEQ ID NO: 427 - DNA, 795 bp, Gossypium hirsutum
  CDS (1)..(795)
atggcctctacaaccatggctctttcttccccatcattcgccggtaaggcagtgaagttctccccttccacccctgaaatccagggaactggccgtgtttccatgaggaaaaccaccaagcctgttccttctggtagcccatggtacggtcctgaccgagttttgtacttgggtccactttccggtgagccaccatcttacttgaccggtgagttccctggtgactatggttgggacactgctggactctcagctgatcccgagacctttgctaggaaccgtgagctcgaagtcattcactgcagatgggccatgttgggagctcttgggtgtgttttccctgagctgttggctaggaacggtgtcaagttcggtgaagctgtatggttcaaggccgggtctcaaatcttcagtgagggtggacttgactacttgggtaacccaagcttgatccatgctcaaagcattttggccatctgggcttgccaagttatcttgatgggagccgtcgagggctaccgtattgccggtggaccactcggtgaagtgactgacccattgtacccaggtggcagctttgacccattgggctttgctgatgacccagaggcattcgctgagctcaaggtgaaagagatcaagaacggtaggttggctatgttctcaatgttcgggttcttcgttcaggccatcgtgaccggaaagggaccattggagaacttggctgaccaccttgctgacccagtcaacaacaatgcttgggcctatgccaccaactttgtccccggaaagtga

SEQ ID NO: 428 - protein, 264 aa, Gossypium hirsutum
MASTTMALSSPSFAGKAVKFSPSTPEIQGTGRVSMRKTTKPVPSGSPWYGPDRVLYLGPLSGEPPSYLTGEFPGDYGWDTAGLSADPETFARNRELEVIHCRWAMLGALGCVFPELLARNGVKFGEAVWFKAGSQIFSEGGLDYLGNPSLIHAQSILAIWACQVILMGAVEGYRIAGGPLGEVTDPLYPGGSFDPLGFADDPEAFAELKVKEIKNGRLAMFSMFGFFVQAIVTGKGPLENLADHLADPVNNNAWAYATNFVPGK

SEQ ID NO: 429 - DNA, 792 bp, Glycine max
  CDS (1)..(792)
atggcagcagcctcctccatggctctctcttccccatccttggctggcaaggccgtgaagctgggcccatcagcccccgaagtcgggagggtcagcatgaggaagaccgtcaccaagcaggcctcctccggaagcccatggtacggcccagaccgcgtcaagtacttgggcccattctctggcgagcccccgtcctacctcactggcgagttcccaggtgactacggctgggacactgctgggctttcggccgacccagaaaccttcgccagaaaccctgagctcgaagtgatccactccaggtgggccatgctcggggccttgggctgcgtcttccccgaactattgtcccgcaacggggtcaagtttggagaagctgtgtggttcaaggccgggtcccagatcttcagcgagggtgggctggactacttgggcaacccaagccttgtccacgcccagagcatcctcgccatctgggccacccaagttatcctaatgggtgctgttgagggttatcgtattgctggtgggcccctcggtgaggtcactgacccaatctaccctggtggcagctttgacccattgggccttgctgatgacccagaggcttttgctgagcttaaggtgaaggaactcaagaacgggagattggccatgttctctatgtttgggttctttgttcaggccattgtcaccggtaagggtccattggagaaccttgctgatcaccttgcggacccagtcaacaacaatgcctgggcctacgccaccaacttcgtccccggcaagtga

SEQ ID NO: 430 - protein, 263 aa, Glycine max
MAAASSMALSSPSLAGKAVKLGPSAPEVGRVSMRKTVTKQASSGSPWYGPDRVKYLGPFSGEPPSYLTGEFPGDYGWDTAGLSADPETFARNPELEVIHSRWAMLGALGCVFPELLSRNGVKFGEAVWFKAGSQIFSEGGLDYLGNPSLVHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 431 - DNA, 801 bp, Hordeum vulgare
  CDS (1)..(801)
atggcggccaccaccatgtacctctcctcatcgacattcgccggaaaggcggtgaagaatgtcccattatcggctctcttcggtgaggctcgcgtcaccatgcgcaagaccgcggcgaaagctaagcaagtttcctccagcagcccatggtacggagctgatcgtgtgctctacctcggcccactctctcgcgagcccccaagctacctcaccggtgatttccccggtgactacgggtgggacacggctggactctctgctgaccccgagaccttctcgaagaaccgcgagttggaggtgatacactgccgctgggctatgcttggtgcactgggttgcgtgttccctgagttgcttgcccgcaatggcgtgaagttcggcgaggctgtctggttcaaggccggctcgcaaatcttcagcgagggtggcctcgactacctcggcaacccaagcctcgtccatgctcagagcatccttgccatttgggcttgccaggttgtgctcatgggcgctgttgaggggtaccgtgttgctggcggcccactcggcgagatcgtcgaccctctctacccgggtggaaggtttgacccacttggcctggccgagcgaccccaagcattcgacgcgctcaaggtgaaggagatcaagaacggccgccttgccatgttctcgatgtttggctttcttgtccaggccatagtcaccggcaagggccctcttgagaacctcgctgaccacatcgccgaccccgtcaacaacaacgcttgggcatttgccacaaacttcgtccccggcaaataa

SEQ ID NO: 432 - protein, 266 aa, Hordeum vulgare
MAATTMYLSSSTFAGKAVKNVPLSALFGEARVTMRKTAAKAKQVSSSSPWYGADRVLYLGPLSREPPSYLTGDFPGDYGWDTAGLSADPETFSKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGRFDPLGLAERPQAFDALKVKEIKNGRLAMFSMFGFLVQAIVTGKGPLENLADHIADPVNNNAWAFATNFVPGK

SEQ ID NO: 433 - DNA, 801 bp, Lactuca sativa
  CDS (1)..(801)
atggctgcttccaccatggctctctcctctcctttcgcaggccaagcagtgaaaacaagtccctcaagttctgagcttttcggaaatggacgggtttccatgaggaagactgcagctgccaagaaggctgcgccatcaggaagtccatggtacggccctgaccgtgtcaagtacctaggcccattctccggcgaggctccatcatacctgaccggtgaattcccaggtgactacggctgggacaccgccggactttctgctgatccagagacattttccaagaaccgtgagcttgaggtcatccactgcagatgggcaatgcttggagctcttggctgcgtcttccctgagctcttggcccgtaatggtgtgaagttcggtgaggctgtatggttcaaggctggatcccagatcttcagtgaaggtgggcttgattacttgggaaaccctagtttggtccatgctcagagcatcttggctatctgggccacccaagtcatcttgatgggtgctgttgagggctacagaattgccggtggaccattgggtgaggttgttgacccactttaccctggtggtagcttcgacccattgggccttgcagatgatccagaggcttttgctgagttgaaggtgaaggagatcaagaatgggagactggctatgttctccatgtttgggttctttgttcaagccattgtcacaggaaaggggccgttggagaacttggctgaccaccttgctgaccctgttgcaaataacgcctggtcttatgctacaaactttgtccccggaaagtga

SEQ ID NO: 434 - protein, 266 aa, Lactuca sativa
MAASTMALSSPFAGQAVKTSPSSSELFGNGRVSMRKTAAAKKAAPSGSPWYGPDRVKYLGPFSGEAPSYLTGEFPGDYGWDTAGLSADPETFSKNRELEVIHCRWAMLGALGCVFPELLARNGVKFGEAVWFKAGSQIFSEGGLDYLGNPSLVHAQSILAIWATQVILMGAVEGYRIAGGPLGEVVDPLYPGGSFDPLGLADDPEAFAELKVKEIKNGRLAMFSMFGFFVQAIVTGKGPLENLADHLADPVANNAWSYATNFVPGK

SEQ ID NO: 435 - DNA, 798 bp, Solanum tuberosum
  CDS (1)..(798)
atggcagctgctacaatggctctttcttccccttcttttgctggacaggcagtgaaactttcaccatctgcctcagaaatttctggaaatggaaggatcactatgagaaaggctgtcgccaagtctgccccatctagcagcccatggtatggccctgaccgtgttaagtacttgggcccattctctggtgagtccccaagttacttgactggtgaattccctggtgactatggatgggataccgctggactttcagcagaccctgagacctttgccaagaaccgtgaacttgaggtgatccactgcagatgggctatgcttggtgctcttggatgtgtcttccctgagctcttggcccgtaacggtgtcaagttcggtgaggctgtgtggttcaaggccggatcccagatcttcagcgagggtggacttgactacttgggcaacccaagcttggtccatgcacaaagcatcttggccatttgggcttgccaagttgtgttaatgggagctgttgagggataccgtattgcaggtggacctcttggtgaggtcgtcgacccactctaccctggtggcagttttgacccattaggtcttgctgatgatccagaggcatttgctgagctcaaagtaaaggagattaagaacggcagacttgctatgttctctatgtttggattcttcgttcaagccattgttaccggaaagggtccattggagaatcttgctgaccaccttgcagatccagtcaacaacaatgcatgggcctttgccacaaactttgttcccggaaaatga

SEQ ID NO: 436 - protein, 265 aa, Solanum tuberosum
MAAATMALSSPSFAGQAVKLSPSASEISGNGRITMRKAVAKSAPSSSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRIAGGPLGEVVDPLYPGGSFDPLGLADDPEAFAELKVKEIKNGRLAMFSMFGFFVQAIVTGKGPLENLADHLADPVNNNAWAFATNFVPGK

SEQ ID NO: 437 - DNA, 798 bp, Solanum tuberosum
  CDS (1)..(798)
atggcagctgctacaatggctctttcttccccttcttttgctggacaggcagtcaaactctcaccctcggcctcagaaatctctggaaatggaaggatcactatgagaaaggctgtcgccaagtcagccccatctagcagcccatggtatggccctgaccgtgttaagtacttaggcccattctctggtgagtccccaagctacttgaccggtgaattccctggtgactacgggtgggataccgctggactttcagcagaccctgaaacctttgccaagaaccgtgaactcgaggtgatccactgcagatgggcaatgcttggtgctcttggatgtgtcttccctgagctattgtcccgtaacggtgtcaagttcggtgaggctgtgtggttcaaggccggatcccagatcttcagcgagggaggacttgactacttgggcaacccaagcttggtccatgcacagagcatcttggccatctgggcttgccaagttgtcttgatgggagccgttgaaggttaccgtattgctggtggacctcttggtgaggttgtcgacccactctaccctggtggcagctttgacccattaggccttgctgaagacccggaggcatttgctgagctcaaggtaaaggagattaagaacggcagacttgctatgttctctatgtttggattcttcgttcaggccattgttaccggaaagggtccattggagaaccttgctgaccaccttgcagaccccgttaacaacaacgcttgggctttcgccacaaactttgtccccggaaaatga

SEQ ID NO: 438 - protein, 265 aa, Solanum tuberosum
MAAATMALSSPSFAGQAVKLSPSASEISGNGRITMRKAVAKSAPSSSPWYGPDRVKYLGPFSGESPSYLTGEFPGDYGWDTAGLSADPETFAKNRELEVIHCRWAMLGALGCVFPELLSRNGVKFGEAVWFKAGSQIFSEGGLDYLGNPSLVHAQSILAIWACQVVLMGAVEGYRIAGGPLGEVVDPLYPGGSFDPLGLAEDPEAFAELKVKEIKNGRLAMFSMFGFFVQAIVTGKGPLENLADHLADPVNNNAWAFATNFVPGK

SEQ ID NO: 439 - DNA, 798 bp, Solanum tuberosum
  CDS (1)..(798)
atggcagctgctacaatggctctttcttccccttcttttgctggacaagcagtgaaactctcaccatctgcctcagaaatcactggaaatggaagaatcactatgagaaaggctgtcgccaagtctgccccatctagcagcccatggtatggccctgaccgtgttaagtacttgggcccattctctggtgagtccccaagctacttgactggtgaattccctggtgactacgggtgggataccgctggactttcagcagaccctgaaacctttgccaagaaccgtgaactcgaggtgatccactgcagatgggctatgcttggtgctcttggatgtgtcttccctgagctcttggcccgtaacggtgtcaagttcggtgaggctgtgtggttcaaagctggatcccaaatcttccgtgagggtggacttgactacttgggaaacccaagtttggtccatgcacaaagcatcttggccatctgggcttgccaagttgtgttgatgggagccgttgaaggttaccgtattgctggtggacctcttggtgaggttgtcaacccactctaccccggtggcagcttcgacccattgggtcttgctgatgacccagaggcatttgctgagctcaaggtaaaggagatcaagaatggtagacttgctatgttctctatgtttggattcttcgttcaagccattgttaccggaaagggtccattggagaaccttgctgaccaccttgcagaccccgttaacaacaacgcctggtcttatgccacaaactttgtccccggaaaatga

SEQ ID NO: 440 - protein, 265 aa, Solanum tuberosum
MAAATMALSSPSFAGQAVKLSPSASEITGNGRITMRKAVAKSAPSSSPWYGPDRVKYLGPFSGESPSYLTGEFPGDYGWDTAGLSADPETFAKNRELEVIHCRWAMLGALGCVFPELLARNGVKFGEAVWFKAGSQIFREGGLDYLGNPSLVHAQSILAIWACQVVLMGAVEGYRIAGGPLGEVVNPLYPGGSFDPLGLADDPEAFAELKVKEIKNGRLAMFSMFGFFVQAIVTGKGPLENLADHLADPVNNNAWSYATNFVPGK

SEQ ID NO: 441 - DNA, 798 bp, Solanum tuberosum
  CDS (1)..(798)
atggcagcttctacaatggctctttcttccccttcttttgctggacaggcagtgaaactctcaccatctacctcagaaatcactggaaatggaaggatcactatgaggaaagcggtagccaagtctgccccatctagcagcccatggtatggtcctgaccgtgttaagtacttgggcccattctctggtgagtccccaagttacttgaccggtgaattccctggtgactatggctgggatactgctggactttcagcagaccctgaaacctttgccaagaaccgtgaactagaggtgatccactgcaggtgggctatgcttggtgctcttggatgtgtcttccctgagctcttggcccgtaacggtgtcaagtttggtgaggctgtgtggttcaaggccggatcccagatcttcagcgagggtggacttgactacttggggaacccaagcttggtccatgcacaaagcatcctggccatttgggcttgccaagttgtgttgatgggagccgttgagggataccgtattgctggtggacctcttggtgaggttatcgacccactctaccccggtggcagctttgacccgttaggccttgctgatgacccagaggcatttgctgagctcaaggtaaaggagatcaagaacggtagacttgctatgttctctatgtttggattctttgttcaggccattgttaccggaaagggtccattggagaaccttgctgaccaccttgcagaccccgttaacaacaatgcctgggcctacgccacaaactttgttcctggaaaatga

SEQ ID NO: 442 - protein, 265 aa, Solanum tuberosum
MAASTMALSSPSFAGQAVKLSPSTSEITGNGRITMRKAVAKSAPSSSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRIAGGPLGEVIDPLYPGGSFDPLGLADDPEAFAELKVKEIKNGRLAMFSMFGFFVQAIVTGKGPLENLADHLADPVNNNAWAYATNFVPGK

SEQ ID NO: 443 - DNA, 798 bp, Solanum tuberosum
  CDS (1)..(798)
atggcagcttctacgatggctctttcttccccttcttttgctggacaggcagtcaaactctcaccctctgcctcagaaatctctggaaatggaaggatcactatgagaaaggctgtcgccaagtctgccccatctagcagcccatggtatggccctgaccgtgttaagtacttaggcccattctctggtgagtccccaagctacttgaccggtgaattccctggtgactacgggtgggataccgctggactttcagcagaccctgaaacctttgccaagaaccgtgaactcgaggtgatccactgcagatgggcaatgcttggtgctcttggatgtgtcttccctgagctattggcccgtaacggtgtcaagttcggtgaggtcgtgtggttcaaggccggatcccagatcttcagcgagggtggacttgactacttgggcaacccaagcttggtccatgcacagagcatcttggccatctgggcttgccaagttgtcttgatgggagctgttgaaggttaccgtattgctggtggacctcttggtgaggttgtcgacccactctaccctggtggcagcttcgacccattaggccttgctgaagacccggaggcatttgctgagctcaaggtaaaggagattaagaacggcagacttgctatgttctctatgtttggattcttcgttcaggcaattgttaccggaaagggtccattggagaaccttgcagaccaccttgcagaccccgttaacaacaacgcctggtcttatgccacaaactttgttcccggaaaatga

SEQ ID NO: 444 - protein, 265 aa, Solanum tuberosum
MAASTMALSSPSFAGQAVKLSPSASEISGNGRITMRKAVAKSAPSSSPWYGPDRVKYLGPFSGESPSYLTGEFPGDYGWDTAGLSADPETFAKNRELEVIHCRWAMLGALGCVFPELLARNGVKFGEVVWFKAGSQIFSEGGLDYLGNPSLVHAQSILAIWACQVVLMGAVEGYRIAGGPLGEVVDPLYPGGSFDPLGLAEDPEAFAELKVKEIKNGRLAMFSMFGFFVQAIVTGKGPLENLADHLADPVNNNAWSYATNFVPGK

SEQ ID NO: 445 - DNA, 804 bp, Solanum tuberosum
  CDS (1)..(804)
atggctgcagctacaatggctctttcttcatctacatttgccggaaaggcagtaaaactctcaccgtcttcttctgaaatcaccggaaatggaagattcaccatgaggaagactgccgccaaggccaagcctgtctcttctggtagtccatggtatggtcctgaccgtgtcaagtatttgggcccattctctggtgaagccccaagctacttgactggtgagaaacctggtgactacggatgggacactgctggactttcagctgatccagaaacttttgccaagaaccgtgagttggaggtgatccattgtagatgggccatcttggaacgtcttggctgtgtctttcctgagcttttgtcccgtaacggtgtaaagtttggtgaggctgtttggttcaaagttggatcccaaattttcagtgaaggtggacttgattacttgggaaacccaagtttggtccatgcacaaagtatcttggccatttgggcttgtcaagttgtgttgatgggagccgttgagggttaccgtattgctggtgggcctcttggtgaggttgttgacccactttatcctggtggtagcttcgacccattgggccttgctgatgatccagaggcttttgcggaactcaaagtaaaagaaatcaagaatggtagacttgctatgttctccatgtttggattcttcgttcaagctattgtcaccggaaaaggcccattggaaaatcttgcagaccaccttgctgatccagttaacaacaacgcatgggcttttgccacaaactttgttcccggaaagtga

SEQ ID NO: 446 - protein, 267 aa, Solanum tuberosum
MAAATMALSSSTFAGKAVKLSPSSSEITGNGRFTMRKTAAKAKPVSSGSPWYGPDRVKYLGPFSGEAPSYLTGEKPGDYGWDTAGLSADPETFAKNRELEVIHCRWAILERLGCVFPELLSRNGVKFGEAVWFKVGSQIFSEGGLDYLGNPSLVHAQSILAIWACQVVLMGAVEGYRIAGGPLGEVVDPLYPGGSFDPLGLADDPEAFAELKVKEIKNGRLAMFSMFGFFVQAIVTGKGPLENLADHLADPVNNNAWAFATNFVPGK

SEQ ID NO: 447 - DNA, 798 bp, Solanum tuberosum
  CDS (1)..(798)
atggctacttctgcaattcaacaatctgcatttgctggccaaacagcacttaagtcacaaaatgaatttattaggaaaattggtagcttcgaaggtggacgtgtcaccatgagacgtactgtcaaaagtgcaccacaaagcatatggtatggagaagacaggccaaagtacttgggaccattttctgagcaaacaccatcatacttgactggtgagttccctggtgactacggatgggacactgctggactctcagctgaccctgagacatttgctaggaacctggagcttgaggtgatccattgtcgttgggccatgcttggtgctttgggatgtgttttccctgaaattttgtctaagaatggtgttacattcggtgaagctgtttggttcaaggctggatctcaaattttctccgaaggcggtcttgactaccttggtaacccaaaccttatccatgctcagagcattcttgccatttgggcatcccaagttgtgttaatgggctttgtggaaggatacagagttggtggaggcccattaggtgaaggcctcgacaagatctacccggggggtgcctttgaccctcttggccttgctgatgatcccgaggcatttgctgagttgaaggtcaaggaaatcaagaatggacgattggctatgttctcgatgtttggtttctttgttcaagctattgttactggaaagggtccaattgagaacctttccgaccacattgctgatccagttgccaacaatgcttgggcttacgccacaaactttgtacccggaaaatga

SEQ ID NO: 448 - protein, 265 aa, Solanum tuberosum
MATSAIQQSAFAGQTALKSQNEFIRKIGSFEGGRVTMRRTVKSAPQSIWYGEDRPKYLGPFSEQTPSYLTGEFPGDYGWDTAGLSADPETFARNLELEVIHCRWAMLGALGCVFPEILSKNGVTFGEAVWFKAGSQIFSEGGLDYLGNPNLIHAQSILAIWASQVVLMGFVEGYRVGGGPLGEGLDKIYPGGAFDPLGLADDPEAFAELKVKEIKNGRLAMFSMFGFFVQAIVTGKGPIENLSDHIADPVANNAWAYATNFVPGK

SEQ ID NO: 449 - DNA, 798 bp, Zea mays
  CDS (1)..(798)
atggcgagcagcaccatggccctctcctccacggccttcgccggcaaggccgtgaacgtgccgtcgtcgtccgccttcgaggcccgcgtgacgatgcgcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggttgcgtcttcccggagctgctcgcccgcaacggcgtcaagttcggcgaggccgttgggttcaaggccggctcccagatcttcagcgagggtggactggactacctcgggaacccgagcctcatccacgcgcagagcatcctcgccatctgggcctgccaggtcgtgctcatgggcgccgtcgagggctaccgcatcgccggcggcccgctcggcgaggtcgtcgacccgctctatcccggcggcagcttcgacccgctgggcctcgccgacgaccccgaggccttcgctgagctcaaggtgaaggagctcaagaagggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtga

SEQ ID NO: 450 - protein, 265 aa, Zea mays
MASSTMALSSTAFAGKAVNVPSSSAFEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVGFKAGSQIFSEGGLDYLGNPSLIHAQSILAIWACQVVLMGAVEGYRIAGGPLGEVVDPLYPGGSFDPLGLADDPEAFAELKVKELKKGRLAMFSMFGFFVQAIVTGKGPLENLADHIADPVNNNAWAYATNFVPGK

SEQ ID NO: 451 - DNA, 795 bp, Glycine max
  CDS (1)..(795)
atggctgcttcaacaatggctctctcttcatcatcattggctggccaagctatcaagcttgccccctccacccctgagcttggtgttggaagggttagcatgaggaaaacagcctccaaaactgtttcctcaggaagcccatggtacggcccagaccgtgtcaagtacttgggcccattctcaggtgagcccccctcctatctcactggtgaattcccaggtgactatggttgggacactgctgggctttctgctgacccagagacttttgccaaaaaccgtgaactggaagtcatccactccagatgggccatgttgggagccttgggctgtgttttccctgaactcttgtcccgcaacggagtcaagtttggcgaggccgtgtggttcaaggccgggtctcagatattcagtgagggtgggcttgactacttgggcaacccaagcctgatccatgcacaaagcattcttgccatctgggccacccaagttatcttgatgggtgccgttgagggttaccgtattgctggtgggcctcttggtgaggtgactgacccaatctatccaggtggcagctttgacccattgggccttgctgatgacccagaggcttttgctgagttgaaggtgaaagagctcaagaatggtaggttggccatgttctccatgtttggtttctttgttcaggcaattgtgacaggaaagggacccttggaaaaccttgctgatcaccttgctgacccagtcaacaacaatgcttgggcttatgccacaaactttgttcccggaaagtga

SEQ ID NO: 452 - protein, 264 aa, Glycine max
MAASTMALSSSSLAGQAIKLAPSTPELGVGRVSMRKTASKTVSSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 453 - DNA, 798 bp, Pisum sativum
  CDS (1)..(798)
atggccacatctgctatccaacaatcagctttcactggtaagactggtttgaggcagggaaatgaattcatcaggaaagctggaaactttggccaagctcgctttaccatgcgtcgtactgtgaagagtgctcctgaaagcatttggtatggtcctgaccgtcccaagtacttgggtccattctctgaacaaattccatcctacctgactggtgaatttcctggtgactatggatgggacacagctggattatcagctgaccctgaaacatttgcaaggaaccgtgagcttgaagtaattcacagcagatgggctatgcttggtgcattgggatgtaccttccccgaactccttgaaaagaatggtgttaaattcggcgaggcagtgtggttcaaagccggttcccagatctttgcggagggtggccttgactatttgggcaacccaaacctgattcatgctcagagcattcttgcaatctgggctactcaggttgtgctcatgggatttgttgaaggctacagagttggaggaggacccctcggcgaaggactagacccactttaccctggtggtgcttttgaccctcttggccttgctgatgaccctgattcatttgcagagttgaaggtcaaggaactcaagaatggtcggctggctatgttctccatgtttggtttctttgttcaagccattgttactggcaagggccctattcagaacctttatgaccatgttgctgaccctgtcgcgaacaacgcatgggcttttgctactaactttgtccctggacaatga

SEQ ID NO: 454 - protein, 265 aa, Pisum sativum
MATSAIQQSAFTGKTGLRQGNEFIRKAGNFGQARFTMRRTVKSAPESIWYGPDRPKYLGPFSEQIPSYLTGEFPGDYGWDTAGLSADPETFARNRELEVIHSRWAMLGALGCTFPELLEKNGVKFGEAVWFKAGSQIFAEGGLDYLGNPNLIHAQSILAIWATQVVLMGFVEGYRVGGGPLGEGLDPLYPGGAFDPLGLADDPDSFAELKVKELKNGRLAMFSMFGFFVQAIVTGKGPIQNLYDHVADPVANNAWAFATNFVPGQ

SEQ ID NO: 455 - DNA, 801 bp, Pisum sativum
  CDS (1)..(801)
atggccgcttcatcaatggctctctcttccccaaccttgactggcaagccagtcaagctgaacccatcaagccaagaattgggaggtgcaaggttcaccatgaggaagtctgctaccaccaagaaagtagcctcctctggaagcccatggtacggaccagaccgtgttaagtacttaggcccattctccggtgagtctccatcctacttgactggagagttccccggtgactacggttgggacactgccggactctctgctgacccagagacattctccaagaaccgtgagcttgaagtcatccactccagatgggctatgttgggtgctttgggatgtgtcttcccagagcttttgtctcgcaacggtgttaaattcggtgaagctgtatggttcaaggcaggatctcaaatctttagcgagggtggacttgactacttgggcaacccaagcttggtccatgctcaaagcatccttgccatctgggccactcaggttatcttgatgggagctgttgaaggttaccgtattgccggtggccctcttggtgaggttgttgacccactttatcctggtggtagctttgatccattaggcttagctgaagatccagaagcttttgcagaattaaaggtaaaggaactgaagaacggtagattagctatgttctcaatgtttggattctttgttcaagctattgtgaccggaaagggacctttggagaatcttgctgatcatctttccgacccagttaacaacaatgcatggtcatatgccaccaactttgttcccggaaagtga

SEQ ID NO: 456 - protein, 266 aa, Pisum sativum
MAASSMALSSPTLTGKPVKLNPSSQELGGARFTMRKSATTKKVASSGSPWYGPDRVKYLGPFSGESPSYLTGEFPGDYGWDTAGLSADPETFSKNRELEVIHSRWAMLGALGCVFPELLSRNGVKFGEAVWFKAGSQIFSEGGLDYLGNPSLVHAQSILAIWATQVILMGAVEGYRIAGGPLGEVVDPLYPGGSFDPLGLAEDPEAFAELKVKELKNGRLAMFSMFGFFVQAIVTGKGPLENLADHLSDPVNNNAWSYATNFVPGK

SEQ ID NO: 457 - DNA, 822 bp, Brassica oleracea
  CDS (1)..(822)
atggccgcctcaacaatggctctctcctcccctgccttcgccggaaaggccgtcaagctttccccagcagcatcagaagtccttggaagcggccgtgtgacaatgaggaagaccgtagccaagccaaagggcccatcaggcagcccatggtacggatccgagagagtcaagtacttgggcccattctccggcgagccaccgagctaccttaccggacagttccccggagactacggatgggacaccgcaggtctctcagccgtacccgagacgttcgtgaggaaccgtgagctagaagttatccactgcaggtgggccatgctcggtgccctaggctgcgtcttcccggagctgttggccaggaacggagtcaagttcggagaggcggtttggttcaaggccggttcgcagatcttcagcgaaggaggacttgattacttgggaaaccctagcttggttcacgctcagagcatcttggctatttgggctactcaagtgatcttgatgggagccgttgaaggttacagagtcccaggagatgggccgttgggagaggccgaggacttgctttacccaggtggcagctttgacccgttgggtttggctactgacccagtggccttcgcggagttgaaggtgaaggagatcaagaacggaagattggctatgttctctatgtttggattctttgttcaagctattgtcactggtaagggacctttggagaatcttgctgaccatttggctgatccagttaacaacaatgcatgggcctttgctaccaacttcgttcccggaaagtcaacgatgttttatctgtaa

SEQ ID NO: 458 - protein, 273 aa, Brassica oleracea
MAASTMALSSPAFAGKAVKLSPAASEVLGSGRVTMRKTVAKPKGPSGSPWYGSERVKYLGPFSGEPPSYLTGQFPGDYGWDTAGLSAVPETFVRNRELEVIHCRWAMLGALGCVFPELLARNGVKFGEAVWFKAGSQIFSEGGLDYLGNPSLVHAQSILAIWATQVILMGAVEGYRVPGDGPLGEAEDLLYPGGSFDPLGLATDPVAFAELKVKEIKNGRLAMFSMFGFFVQAIVTGKGPLENLADHLADPVNNNAWAFATNFVPGKSTMFYL

SEQ ID NO: 459 - DNA, 798 bp, Nicotiana tabacum
  CDS (1)..(798)
atggccacttctgcaattcaacaatctgcatttgttggccagacagtggctaaatcacaaaatgagctagttaggaaaattggcagctttggcggtggccgtgctaccatgagacgtaccgttaaaagtgctcctcaaagcatctggtatggagaagaccgcccaaaatatttgggcccattctctgagcaaactccatcatacctcaccggtgagttcccaggtgactatggttgggacactgctggactctcagctgacccagagacattcgctagaaaccgtgaacttgaggtgatccattgccgttgggccatgcttggtgctttgggttgtgtctttcccgaaatcctttcaaaaaatggtgttaaattcggtgaagctgtttggttcaaggcaggagcccaaatcttctcggaaggtggacttgactacctcggcaacccaaaccttgtccatgcccaaagcatcctcgctatttgggcatgccaagttgtcctaatgggcttgattgaaggatatagggttggtgggggcccacttggtgaaggtcttgacaagatttacccaggaggtgcctttgacccacttggccttgctgatgatcccgaggcttttgctgagctaaaggttaaggaaatcaagaacggacgattggctatgttttcaatgttcggattctttgttcaggctattgttactggaaaaggcccaattgagaacctctttgaccagattaatgacccagtggccaataatgcttgggcttttgccactaactttgtacccggaaagtga

SEQ ID NO: 460 - protein, 265 aa, Nicotiana tabacum
MATSAIQQSAFVGQTVAKSQNELVRKIGSFGGGRATMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGAQIFSEGGLDYLGNPNLVHAQSILAIWACQVVLMGLIEGYRVGGGPLGEGLDKIYPGGAFDPLGLADDPEAFAELKVKEIKNGRLAMFSMFGFFVQAIVTGKGPIENLFDQINDPVANNAWAFATNFVPGK

SEQ ID NO: 461 - DNA, 801 bp, Brassica oleracea
  CDS (1)..(801)
atggctgcctcaaccatggctctgtcctcccctgcctttgccggaaaggccgtgaagctctcaccgggagcctcagaggtctttggaaccggccgtgtcaccatgagaaaaaccgtcaaacccaccggtccatctggcagcccatggtacggatccgacagggtcaagtacttgggtccattctccggagagcccccaagctacctcacaggagagttccccggtgactacggatgggacaccgccggtctttccgctgaccccgagaccttcgccaggaaccgtgagctagaagttatccactgcagatgggccatgcttggagccctaggctgtgttttccctgaacttttggctaggaacggagtgaagttcggagaagctgtttggttcaaggctggttcacagatcttcagcgaaggagggctcgactacttgggaaacccgagcttggtccacgcacagagcatcttagccatttgggctactcaggtgatcctcatgggagctgttgaaggttacagagtcgccggagaaggaccattgggggaagcagaggacttgctctacccaggaggcagctttgacccgttgggtcttgctgccgacccagaagctttcgcggagttgaaggtgaaggagatcaagaacggaaggttggctatgttctctatgtttggattcttcgttcaggctatcgtcaccggaaagggaccgttggagaatcttgctgaccatttggctgatccagtcaacaacaatgcatgggcctttgccaccaacttcgtccccggaaagtga

SEQ ID NO: 462 - protein, 266 aa, Brassica oleracea
MAASTMALSSPAFAGKAVKLSPGASEVFGTGRVTMRKTVKPTGPSGSPWYGSDRVKYLGPFSGEPPSYLTGEFPGDYGWDTAGLSADPETFARNRELEVIHCRWAMLGALGCVFPELLARNGVKFGEAVWFKAGSQIFSEGGLDYLGNPSLVHAQSILAIWATQVILMGAVEGYRVAGEGPLGEAEDLLYPGGSFDPLGLAADPEAFAELKVKEIKNGRLAMFSMFGFFVQAIVTGKGPLENLADHLADPVNNNAWAFATNFVPGK

SEQ ID NO: 463 - DNA, 798 bp, Glycine max
  CDS (1)..(798)
atggccacctctgctattcagcaatcagcattcgcaggtcaaactgctctgaagcagctcaatgagttggtccgcaagaccggtggcgccggcaaaggtcgcaccaccatgcgccgtaccgtcaagagtgctcctcagagcatttggtatggccctgatcgtcccaagtacctgggtccattctcagagcagattccgtcatacctgaccggagaattccccggtgactacggatgggacactgctggactatcagctgacccggaaaccttcgccaggaaccgggagctggaggtgattcacagcagatgggccatgcttggtgcacttggctgcaccttcccagagatccttgagaagaatggtgtgaaattcggcgaggccgtgtggttcaaggctggttcacagatcttctcggagggaggacttgactacttgggcaacccaaacctgatccatgctcaaagcatccttgccatctgggctgttcaggttgtgctcatgggttttgttgaaggttacagagttggtggaggaccccttggtgaaggacttgaccctatctaccctggtggtgcatttgaccctcttggtctggctgatgaccctgatgcattcgctgagttgaaggtcaaggaactcaagaacggtcgcttggctatgttctccatgtttggtttctttgttcaggccattgtcactggcaagggccctattcagaacctttacgaccatgttgctgatcctgttgccaacaatgcttgggcttatgccactaactttgtccctggacaatga

SEQ ID NO: 464 - protein, 265 aa, Glycine max
MATSAIQQSAFAGQTALKQLNELVRKTGGAGKGRTTMRRTVKSAPQSIWYGPDRPKYLGPFSEQIPSYLTGEFPGDYGWDTAGLSADPETFARNRELEVIHSRWAMLGALGCTFPEILEKNGVKFGEAVWFKAGSQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIQNLYDHVADPVANNAWAYATNFVPGQ

SEQ ID NO: 465 - DNA, 807 bp, Arabidopsis thaliana
  CDS (1)..(807)
atggccgcctcgacaatggctctctcctctcctgctttgaccggaaaggccgttaagctatccccggcggcctccgaagtatttggaaccggccgaatcaccatgcgcaaagcctccaagcccaccggtccatccggcagcccatggtacggatccgaccgagtcaagtacttgggtccattctccggtgagcctccgagctacctcactggagagttccccggtgattacgggtgggacactgccggtctatccgccgatcccgagaccttcgctaggaaccgtgagctagaagttatccacagcagatgggccatgctcggagccctaggctgcgttttccctgagctattggctaggaacggagtgaagttcggagaagccgtttgggttcagggctggttcacagatcttcagcgacggaggattggacctacttgggccaccccgagcttggtccacgctcaagagcattttagccatttgggctactcaagttatcctcatggaagcctgttgagggctaccagagtccccggaaatggtccattgggagaagcagaggacttgctttacccaggtgggagcttcgacccattgggcctcgctactgaccccgaggctttcgcggagttgaaggtgaaggagctcaagaacggaaggttggctatgttctctatgtttggattcttcgttcaggccattgtcaccggaaagggaccgttggagaacctcgcggaccacttggctgatccagtcaacaacaatgcatgggccttcgctaccaacttcgtccccggaaagtga

SEQ ID NO: 466 - protein, 268 aa, Arabidopsis thaliana
MAASTMALSSPALTGKAVKLSPAASEVFGTGRITMRKASKPTGPSGSPWYGSDRVKYLGPFSGEPPSYLTGEFPGDYGWDTAGLSADPETFARNRELEVIHSRWAMLGALGCVFPELLARNGVKFGEAVWVQGWFTDLQRRRIGPTWATPSLVHAQEHFSHLGYSSYPHGSLLRATRVPGNGPLGEAEDLLYPGGSFDPLGLATDPEAFAELKVKELKNGRLAMFSMFGFFVQAIVTGKGPLENLADHLADPVNNNAWAFATNFVPGK

SEQ ID NO: 467 - DNA, 798 bp, Arabidopsis thaliana
  CDS (1)..(798)
atgggaacatcagctatccagcaatcctccttcgccggccaaacggctctcaagccctccaacgaactcctccgcaaggttggtgtctccggtggtggccgtgtgaccatgcgtcgtaccgtcaagtctactcctcaaagcatttggtacggaccagaccgtcccaagtacttgggaccattctcggagaacacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggctctcagattttctcagaaggaggtcttgattacctcggaaaccctaacttgatccacgcgcaaagcatcttagccatctgggctgttcaagttgtgctcatggggttcattgaaggctacagaatcggaggtggaccactcggagaaggacttgacccgctttatcccggaggtgcgttcgacccattgaacttggctgaggatccagaggctttctctgagctgaaggtgaaggagctcaagaacggtcgtcttgccatgttctctatgtttggattctttgtccaagccattgttactggtaaaggtcccattgagaacttatttgatcatttggctgatcctgtggctaacaacgcctggtcttacgctactaactttgtccccggaaagtaa

SEQ ID NO: 468 - protein, 265 aa, Arabidopsis thaliana
MGTSAIQQSSFAGQTALKPSNELLRKVGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWAVQVVLMGFIEGYRIGGGPLGEGLDPLYPGGAFDPLNLAEDPEAFSELKVKELKNGRLAMFSMFGFFVQAIVTGKGPIENLFDHLADPVANNAWSYATNFVPGK

SEQ ID NO: 469 - DNA, 798 bp, Arabidopsis thaliana
  CDS (1)..(798)
atggcaacatcagctatccagcaatcctccttcgccggccaaacggctctcaagccctccaacgaactcctccgcaaggttggtgtatccggtggtggccgtgtgaccatgcgtcgtaccgtcaagtctactcctcaaagcatctggtacggaccagaccgtcccaagtacttaggaccattctcggagaatacaccgtcctacctaaccggagaataccccggagactacggctgggacaccgctggactctcggctgacccggagacattcgctaagaaccgtgagcttgaagtaatccacagcagatgggctatgttgggtgctctcggatgcacattccctgagattctctccaagaacggtgttaaattcggagaagccgtgtggttcaaggcaggttctcagattttctcagaaggaggtcttgattacctcggaaaccctaacttgatccacgcgcaaagcatcttagccatctgggctgttcaagttgtgctcatggggttcattgaaggctacagaatcggaggtggacctctcggagaagggcttgacccgctttaccccggaggtgcgttcgacccattgaacttggctgaggatccagaggctttctctgagctgaaggtgaaggagcttaagaacggtcgtcttgccatgttctctatgtttggattctttgtccaagccattgttactggtaaaggtcccattgagaacttatttgatcatttggctgatcctgtggctaacaacgcctggtcttacgctactaactttgtccccggaaagtaa

SEQ ID NO: 470 - protein, 265 aa, Arabidopsis thaliana
MATSAIQQSSFAGQTALKPSNELLRKVGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWAVQVVLMGFIEGYRIGGGPLGEGLDPLYPGGAFDPLNLAEDPEAFSELKVKELKNGRLAMFSMFGFFVQAIVTGKGPIENLFDHLADPVANNAWSYATNFVPGK

SEQ ID NO: 471 - DNA, 798 bp, Gossypium hirsutum
  CDS (1)..(798)
atggcaacctctgctatccaacaatctgctttcgctggccaaacagctttgaagcagtccaatgagctcgtctgcaagatcggtgccgtcggtggtggtcgcgtttccatgcgtagaaccgtcaaaagtgctccaaccagcatctggtatggccctgaccgcccaaagtacttgggtccattctctgaccaaatcccatcatacctgaccggtgaattccctggggactacgggtgggatactgctggattatcagctgacccagagacatttgccaagaaccgtgagcttgaggtgatccactgtaggtgggctatgcttggtgcccttggctgtgttttccctgaaattctttcaaagaatggtgtcaagttcggagaggcggtttggttcaaggctggttcccaaatcttctccgagggtggccttgactatctcggcaacccaaacctcatccatgctcagagtattcttgctatctgggcttgccaagttgtgctcatgggatttgttgaagggtacagagttggtggtggaccactcggtgaaggactcgacccaatttacccaggtggtgcttttgacccgcttggattggctgatgaccctgatgccttcgcggaattgaaggttaaggagatcaagaacggccgcctggcaatgttctccatgtttgggttcttcgtccaggctattgtcactggaaagggtcccatcgagaaccttttcgaccaccttgctgatccggtggccaacaatgcttgggcttatgccactaactttgtccccggaaaatga

SEQ ID NO: 472 - protein, 265 aa, Gossypium hirsutum
MATSAIQQSAFAGQTALKQSNELVCKIGAVGGGRVSMRRTVKSAPTSIWYGPDRPKYLGPFSDQIPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFVPGK

SEQ ID NO: 473 - DNA, 789 bp, Zea mays
  CDS (1)..(789)
atggctgcctccaccatggcgatctcctccacggcgatggccggcacccccatcaaggtgggttccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagacattcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccggcaactaa

SEQ ID NO: 474 - protein, 262 aa, Zea mays
MAASTMAISSTAMAGTPIKVGSFGEGRITMRKTVGKPKVAASGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHIADPVNNNAWAYATNFVPGN

SEQ ID NO: 475 - DNA, 798 bp, Oryza sativa
  CDS (1)..(798)
atggccgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtcctctacctcggcccgctctccggcgagccgccgagctacctcaccggcgagttcccgggcgactacgggtgggacaccgcggggctctccgccgacccggagacgttcgccaagaaccgggagctggaggtgatccactcccggtgggcgatgctgggcgcgctcggctgcgtcttcccggagctcctcgcccggaacggcgtcaagttcggcgaggccgtgtggttcaaggcgggctcgcagatcttcagcgagggcgggctcgactacctcggcaacccgagcctgatccacgcgcagagcatcctcgccatctgggcggtgcaggtggtgctcatgggcgccgtcgaggggtaccgcatcgccggcgggccgctcggcgaggtcgtcgacccgctctaccccggcggcgccttcgacccgctcggcctcgccgatgaccccgaggcgttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcgtacgccaccaacttcgtccccggcaagtga

SEQ ID NO: 476 - protein, 265 aa, Oryza sativa
MAAATMALSSPVMARAAPSTSSALFGEARITMRKTAAKPKPAASSGSPWYGADRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGAFDPLGLADDPEAFAELKVKEIKNGRLAMFSMFGFFVQAIVTGKGPLENLADHLADPVNNNAWAYATNFVPGK

SEQ ID NO: 477 - DNA, 801 bp, Nicotiana tabacum
  CDS (1)..(801)
atggctgcttctaccacagctctttcttctccttttgccggaaaggcggtaaaactctcaccatcttcctctgaagttactggaaatgggaaagttactatgaggaagactgctagcaaggccaagcctgtctcttctggtagcccatggtatggtcctgaccgtgtcaagtacttgggcccattctctggtgagtctccaagctacttgactggtgagtttcctggtgattacgggtgggacactgctggactttcagctgatccagaaacattcgccaagaaccgtgagttggaggtgatccactgcagatgggccatgcttggagctcttggttgtgtcttccccgaactcttggcacgtaatggtgtcaagttcggtgaagctgtatggttcaaggctggatcccaaatttttagcgagggtggacttgactacttgggcaacccaagtttggtccacgcacaaagcatcttggccatttgggcttgccaagttgtgttgatgggagctgtcgagggttaccgtgttgctggtggacctctcggtgaggttgttgacccactttaccccggtggcagcttcgacccattgggccttgctgaagatccagaggctttcgctgagctcaaggtaaaggaaatcaagaatggtagacttgctatgttctccatgtttggattctttgttcaggctatcgtcaccggaaagggtccattggagaaccttgctgaccaccttgctgacccggttaacaacaacgcctggtcttatgccactaactttgttcccggaaagtga

SEQ ID NO: 478 - protein, 266 aa, Nicotiana tabacum
MAASTTALSSPFAGKAVKLSPSSSEVTGNGKVTMRKTASKAKPVSSGSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLAEDPEAFAELKVKEIKNGRLAMFSMFGFFVQAIVTGKGPLENLADHLADPVNNNAWSYATNFVPGK

SEQ ID NO: 479 - DNA, 801 bp, Triticum aestivum
  CDS (1)..(801)
atggcggccaccaccatgtctctttcctcttcgtccttcgccggcaaggccgtcaagaacttgccctcgtcggctctcattggtgacgcacgtgtgaacatgcgcaagactgcggcgaaggccaaacaagtttcgtcgagcagcccgtggtacggctctgaccgtgtgctctacctcggcccgctttccggcgagccccccagctacttgactggtgagttccccggtgactatgggtgggacaccgccgggctctcggctgaccctgagaccttcgccaagaaccgggagctcgaggtgatccactgccgatgggccatgctcggtgcgcttggttgtgtctttcccgagttgcttgcccgcaatggtgtgaagttcggcgaggccggttggttcaaggctggctctcagatcttcagcgatggtggcctcgactaccttggcaaccccagcctcgtccacgcccagagcctcctcgccatatgggcttgtcaagttgtgctcatgggggccgttgaggggtaccgcattgctggtggtccgctcggcgagatcgtcgacccactctaccctggtggcagctttgacccacttggcctggccgagcgaccccaggcatttgcggagctcaaggttaaggagatcaagaatggccgcctcgccatgttctccatgtttggcttctttgtgcaggccattgtcaccggcaagggcccattggaggaccttgccgaccacattgccgaccctgtcaacaacaacgcgtggctcattgccaccaacttcgtgcccgggaaataa

SEQ ID NO: 480 - protein, 266 aa, Triticum aestivum
MAATTMSLSSSSFAGKAVKNLPSSALIGDARVNMRKTAAKAKQVSSSSPWYGSDRVLYLGPLSGEPPSYLTGEFPGDYGWDTAGLSADPETFAKNRELEVIHCRWAMLGALGCVFPELLARNGVKFGEAGWFKAGSQIFSDGGLDYLGNPSLVHAQSLLAIWACQVVLMGAVEGYRIAGGPLGEIVDPLYPGGSFDPLGLAERPQAFAELKVKEIKNGRLAMFSMFGFFVQAIVTGKGPLEDLADHIADPVNNNAWLIATNFVPGK

SEQ ID NO: 481 - DNA, 795 bp, Hordeum vulgare
  CDS (1)..(795)
atggccgccgcgaccatggctctgtcttcctccaccttcgccgggaaggcggtgaaaaacctgtcttcctcgtcagaggtgcagggcgacgccagagtctcaatgaggaagaccgccgccaccaagaaggtcggcagcccctggtacggcccggaccgggtcaagtacctgggcccctttagcggggagtccccgtcctacctgaccggcgagttccccggagactacgggtgggacacggccgggctcagcgccgaccccgagaccttcgccaagaaccgcgagctggaggtgatccacgggcgctgggcgatgctgggggcgctcgggtgcgtcttcccggagctcctcgcccggaacggcgtcaagtttggcgaggccgtgtggttcaagaagggttcccagatctttagcgagggcgggctgcagtacctggggaacccctccctggtccacgcgcagagcatcctggccatctgggcctgccaggtggtcctcatgggtgccgtcgaaggctaccgcgtggccggcggtcccctgggcgaggtggtggaccccctgtaccccggcggcagctttgaccccctcgggctcgcggacgacgcggaagccttcgccgagctgaaggtcaaggagatcaagaacggacgcctggccatgttctccatgttcggattcttcgtgcaggccatcgtcaccgggaaggggcccctcgagaacttggcggaccatctcgccgaccccgtaaacaacaatgcctgggccttcgccaccaacttcgtccccggcaagtaa

SEQ ID NO: 482 - protein, 264 aa, Hordeum vulgare
MAAATMALSSSTFAGKAVKNLSSSSEVQGDARVSMRKTAATKKVGSPWYGPDRVKYLGPFSGESPSYLTGEFPGDYGWDTAGLSADPETFAKNRELEVIHGRWAMLGALGCVFPELLARNGVKFGEAVWFKKGSQIFSEGGLQYLGNPSLVHAQSILAIWACQVVLMGAVEGYRVAGGPLGEVVDPLYPGGSFDPLGLADDAEAFAELKVKEIKNGRLAMFSMFGFFVQAIVTGKGPLENLADHLADPVNNNAWAFATNFVPGK

SEQ ID NO: 483 - DNA, 798 bp, Zea mays
  CDS (1)..(798)
atggcgagcagcaccatggccctctcctccacggccttcgccggcaaggccgtgaacgtgccgtcgtcgtccttcggcgaggcccgcgtgacgatgcgcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactgccgctgggccatgctgggcgcgctcggttgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctgggcctcgccgacgaccccgaggccttcggcgagctcaaggtcaaggagctcaagaagggccgcctcgccatgttgtccatgttcggattcttcgtccaggccatcgtcaccgggaagggcccgctcgagaacctcgctgaccacattgccgaccccgtcaacaacaacgcttgggcctacgccaccaacttcgtccccggcaagtga

SEQ ID NO: 484 - protein, 265 aa, Zea mays
MASSTMALSSTAFAGKAVNVPSSSFGEARVTMRKTAAKAKPAAASGSPWYGPDRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFGELKVKELKKGRLAMLSMFGFFVQAIVTGKGPLENLADHIADPVNNNAWAYATNFVPGK

SEQ ID NO: 485 - DNA, 786 bp, Oryza sativa
  CDS (1)..(786)
atggccgccgccaccatggccctctcgtccccggcgctggccggcaaggccgccgcgaaggtgttcggcgaggggcgcatcaccatgcgcaagtcggcggcgaagcccaagcccgccgcgtcggggagcccgtggtacggcgccgaccgcgtgctctacctcggcccgctctccggcgagccgccgagctacctgaccggcgagttccccggcgactacgggtgggacaccgcggggctctccgccgacccggagacgttcgccaagaaccgggagctggaggtgatccactccaggtgggcgatgctcggcgcgctgggctgcgtgttcccggagctcctcgcccgcaacggcgtcaagttcggcgaggcggtgtggttcaaggcggggtcgcagatcttcagcgagggcgggctcgactacctcggcaacccgagcctgatccacgcgcagagcatcctcgccatctgggcggtccaggtggtgctcatgggcgccgtcgaggggtaccgcatcgccggcgggccgctcggcgaggtcgtcgacccgctctaccccggcggcagcttcgacccgctcggcctcgccgacgacccggaggccttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcctacgccaccaacttcgtccccggcaagtga

SEQ ID NO: 486 - protein, 261 aa, Oryza sativa
MAAATMALSSPALAGKAAAKVFGEGRITMRKSAAKPKPAASGSPWYGADRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWAVQVVLMGAVEGYRIAGGPLGEVVDPLYPGGSFDPLGLADDPEAFAELKVKEIKNGRLAMFSMFGFFVQAIVTGKGPLENLADHLADPVNNNAWAYATNFVPGK

SEQ ID NO: 487 - DNA, 810 bp, Pisum sativum
  CDS (1)..(810)
atggccgcatcatcatcatcatccatggctctctcttctccaaccttggctggcaagcaactcaagctgaacccatcaagccaagaattgggagctgcaaggttcaccatgaggaagtctgctaccaccaagaaagtagcttcctctggaagcccatggtacggaccagaccgtgttaagtacttaggcccattctccggtgagtctccatcctacttgactggagagttccccggtgactacggttgggacactgccggactctctgctgacccagagacattctccaagaaccgtgagcttgaagtcatccactccagatgggctatgttgggtgctttgggatgtgtcttcccagagcttttgtctcgcaacggtgttaaattcggcgaagctgtgtggttcaaggcaggatctcaaatctttagtgagggtggacttgattacttgggcaacccaagcttggtccatgctcaaagcatccttgccatatgggccactcaggttatcttgatgggagctgtcgaaggttaccgtattgccggtgggcctctcggtgaggtggttgatccactttacccaggtggaagctttgatccattgggcttagctgatgatccagaagcattcgcagaattgaaggtgaaggaactcaagaacggtagattagccatgttctcaatgtttggattcttcgttcaagctattgtaactggaaagggtcctttggagaaccttgctgatcatcttgcagacccagtcaacaacaatgcatggtcatatgccaccaactttgttcccggaaaataa

SEQ ID NO: 488 - protein, 269 aa, Pisum sativum
MAASSSSSMALSSPTLAGKQLKLNPSSQELGAARFTMRKSATTKKVASSGSPWYGPDRVKYLGPFSGESPSYLTGEFPGDYGWDTAGLSADPETFSKNRELEVIHSRWAMLGALGCVFPELLSRNGVKFGEAVWFKAGSQIFSEGGLDYLGNPSLVHAQSILAIWATQVILMGAVEGYRIAGGPLGEVVDPLYPGGSFDPLGLADDPEAFAELKVKELKNGRLAMFSMFGFFVQAIVTGKGPLENLADHLADPVNNNAWSYATNFVPGK

SEQ ID NO: 489 - DNA, 771 bp, Glycine max
  CDS (1)..(771)
atggctgcttcaacaatggctctctcttcatcatcattggctggtcaagcaatgaagcttgccccctccacccctgagcttggtgttggaagagttagcatgaggaaaacagcccccaagactgtttcctcaggaagcccatggtatggcccagaccgtgtcaagtacttgggcccattttccggtgaagctccctcctaccttactggtgaattccatgggctttctgctgatccagagacttttgccaaaaaccgagaactcgaagtcatccactccagatgggccatgttgggagccctgggctgtgttttccccgaactcttggcccgcaatggtgtcaagtttggagaggccgtatggttcaaggccgggtctcagatattcagtgagggtgggcttgactacttgggcaacccaagcctgatccatgcacaaagcattcttgccatctgggccacccaagttatcttgatgggtgccgttgagggttaccgtattgcaggtgggcctcttggtgaggtgactgacccaatctacccaggtggcagctttgatccattgggccttgctgatgacccagaggctttggccgagttaaaggtgaaagagctcaagaatggtaggttggctatgttttccatgtttggattctttgttcaggctattgtgactggaaagggacccttagagaacttggccgaccaccttgctgatccagtaaacaacaatgcctgggcctatgccaccaaactttgtcctggaaagtga

SEQ ID NO: 490 - protein, 256 aa, Glycine max
MAASTMALSSSSLAGQAMKLAPSTPELGVGRVSMRKTAPKTVSSGSPWYGPDRVKYLGPFSGEAPSYLTGEFHGLSADPETFAKNRELEVIHSRWAMLGALGCVFPELLARNGVKFGEAVWFKAGSQIFSEGGLDYLGNPSLIHAQSILAIWATQVILMGAVEGYRIAGGPLGEVTDPIYPGGSFDPLGLADDPEALAELKVKELKNGRLAMFSMFGFFVQAIVTGKGPLENLADHLADPVNNNAWAYATKLCPGK

SEQ ID NO: 491 - DNA, 798 bp, Nicotiana tabacum
  CDS (1)..(798)
atggctgctgctacaatggctctttcttccccttctttcgctggacaggcagtgaaactctccccatctgccccagaaatcaccggaaatggaagggtctccatgagaaagactgtcgccaaacccgtcgcatctagcagcccatggtacggcccagaccgtgttaagtacttgggtccattctccggtgagtccccaagctacttgaccggtgaattccccggtgattacgggtgggatactgctggactttcagcagacccagaaacctttgccaagaaccgtgaactcgaggtgatccactgcagatgggctatgcttggtgctcttggatgtgtcttccccgagctcttggcccgtaatggtgtcaagtttggcgaggctgtgtggttcaaggctggatcccaaatctttagcgagggtggacttgactacttgggcaacccaagcttggtccatgcacaaagcatcttggccatctgggcttgccaagttatcttgatgggagccgttgagggttaccgtgttgctggtgggcctcttggtgaggttgtcgacccactctaccctggtggcagctttgacccactgggcctcgctgaggacccagaggcatttgctgagctcaaggtaaaggagattaagaacggaagacttgccatgttctctatgttcggattctttgttcaggccattgttactggaaaaggtccattggagaaccttgctgaccatcttgcagacccagttaacaacaatgcttgggcatacgccacaaactttgtccccggaaagtga

SEQ ID NO: 492 - protein, 265 aa, Nicotiana tabacum
MAAATMALSSPSFAGQAVKLSPSAPEITGNGRVSMRKTVAKPVASSSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVILMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 493 - DNA, 795 bp, Apium graveolens
  CDS (1)..(795)
atggctgcttcaacaatggccctctcttctccagctttggctggaaaggcagtcaaagtagctccatcttcatctgagctctttggaaatggaagagtttcgatgagaaagactgtcaaggcaccggtgtctgacagcccatggtacggtccagaccgtgtcaagtacttgggaccattctctggtgaagccccatcttaccttactggtgagtttccaggtgactatggctgggacactgctgggctttcggctgaccctgagacttttgccaagaaccgtgaacttgaagtgatccactccagatgggccatgcttggagcccttgggtgtgtcttccctgagctcttggctcgtaatggtgtcaagtttggcgaggcagtgtggtttaaggctggatcacaaatcttcagcgagggtggacttgactacttgggtaacccaagcttggtccatgcacaaagcatattatctatctgggctactcaagtcatcttgatgggcgcagttgagggttaccgtgttgctggtggaccactaggggaaattgtcgaccccctttaccctggaggaagctttgacccattaggccttgctgaagacccagagcgatctgcagagcttaaggtgaaggagctgaaaaatggaagactagccatgttctccatgtttggattctttgtacaagctattgtgaccggaaagggtccattagagaacttggctgaccaccttgcagaccctgttaacaacaatgcctgggcctttgccactaactttgttcccggaaagtga

SEQ ID NO: 494 - protein, 264 aa, Apium graveolens [sequence omitted]

SEQ ID NO: 495 - DNA, 807 bp, Hordeum vulgare
  CDS (1)..(807)
atggcatccacgatcatggccgccgcctcccgcgccgttgtcgccaagacgccgttcctcagcggccagggccgcgccgccagcgccagccccctgcgcgacatcgccgccgcgaccaacggcagaatcaccatgggcaacgacttgtggtacggcccggaccgcgtcaagtacctgggccccttctccgcgcagacgccgtcgtaccttaacggcgagttccccggcgactacggctgggacaccgccgggctttctgccgacccggaggcgttcgctaggaacagggcgctagaggtgatccacggccggtgggcgatgctcggcgctcttgggtgcgtcttccccgaggtgctccagaagtgggtgggcgtcgagttcaaggagcccgtctggttcaaggccggctctcagatcttctctgagggtggtctcgattaccttgggaaccccaaccttgtccacgcgcagagcatccttgccgtgcttggcttccaggtccttctcatgggtcttgttgaagggttccgcatcaacggtctcgatggtgtcggcgagggcaacgacctctaccccggcggccagtacttcgacccgctcggccttgccgacgaccctgttaccttcgcggagcttaaggtgaaggagatcaagaatggccgtcttgccatgttctctatgttcgggttcttcgtgcaagctatcgtcaccggcaagggcccattggagaacctgttcgaccacctcgacgaccctgtcgccaataatgcatgggttttcgccaccaaatttgcgcctggatcttag

SEQ ID NO: 496 - protein, 268 aa, Hordeum vulgare
MASTIMAAASRAVVAKTPFLSGQGRAASASPLRDIAAATNGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 497 - DNA, 792 bp, Oryza sativa
  CDS (1)..(792)
atggccgcgtcggcgctgcaccagaccaccagcttcctcggcaccgcccctcgccgggatgagctcgtccgccgcgtcggcgactccggtggccgcatcaccatgcgccgcaccgtcaagagcgcgccccagagcatctggtatggacctgaccgtcccaagtacctgggcccgttctcggagcagacgccatcgtacctgaccggagagttcccgggagactacgggtgggacacggcggggctatcggccgacccggagacgttcgcgaggaacagggagctggaggtgatccactcgcggtgggcgatgctgggggcgctgggctgcgtcttcccggagatcctgtccaagaacggggtgaagttcggggaggcggtgtggttcaaggccggcgcgcagatcttctccgagggggggctcgactacctggggaaccccaacctggtgcacgcgcagagcatcctcgccatctgggcggtccaggtggtgctcatgggattcgtcgagggctaccgcgtcggcggcggcccgctcggcgagggcctcgacaaggtgtacccaggcggcgccttcgacccgctcggcctcgccgacgaccctgacaccttcgccgagctcaaggtgaaggagctcaagaacggccgcctcgccatgttctccatgttcggcttcttcgtccaggccatcgtcaccggcaagggccccatcgagaacctcttcgaccacgtcgccgaccccgtcgccaacaacgcctgggcatacgccaccaacttcgtccccggcaagtga

SEQ ID NO: 498 - protein, 263 aa, Oryza sativa
MAASALHQTTSFLGTAPRRDELVRRVGDSGGRITMRRTVKSAPQSIWYGPDRPKYLGPFSEQTPSYLTGEFPGDYGWDTAGLSADPETFARNRELEVIHSRWAMLGALGCVFPEILSKNGVKFGEAVWFKAGAQIFSEGGLDYLGNPNLVHAQSILAIWAVQVVLMGFVEGYRVGGGPLGEGLDKVYPGGAFDPLGLADDPDTFAELKVKELKNGRLAMFSMFGFFVQAIVTGKGPIENLFDHVADPVANNAWAYATNFVPGK

SEQ ID NO: 499 - DNA, 798 bp, Pisum sativum
  CDS (1)..(798)
atggccacctctgctatccaacaatcagctttcactggtaagactggtttgaggcagggaaatgaattcatcaggaaacgtggaaactttggccaagctcgctttaccatgcgtcgtactgtgaagagtgctcctgaaagcatttggtatggtcctgaccgtcccaagtacttgggtccattctctgaacaaattccatcctacctgactggtgaatttcctggtgactatggatgggacacagctggattatcagctgaccctgaaacatttgcaaggaaccgtgagcttgaagtaattcacagcagatgggctatgcttggtgcattgggatgtaccttccccgaactccttgaaaagaatggtgttaaattcggcgaggcagtgtggttcaaagccggttcccagatctttgcggagggtggccttgactatttgggcaacccaaacctgattcatgctcagagcattcttgcaatctgggctactcaggttgtgctcatgggatttgttgaaggctacagagttggaggaggacccctcggcgaaggactagacccactttaccctggtggtgcttttgaccctcttggccttgctgatgaccctgattcatttgcagagttgaaggtcaaggaactcaagaatggtcggctggctatgttctccatgtttggtttctttgttcaagccattgttactggcaagggccctattcagaacctttatgaccatgttgctgaccctgtcgcgaacaacgcatgggcttttgctactaactttgtccccggacaatga

SEQ ID NO: 500 - protein, 265 aa, Pisum sativum
MATSAIQQSAFTGKTGLRQGNEFIRKRGNFGQARFTMRRTVKSAPESIWYGPDRPKYLGPFSEQIPSYLTGEFPGDYGWDTAGLSADPETFARNRELEVIHSRWAMLGALGCTFPELLEKNGVKFGEAVWFKAGSQIFAEGGLDYLGNPNLIHAQSILAIWATQVVLMGFVEGYRVGGGPLGEGLDPLYPGGAFDPLGLADDPDSFAELKVKELKNGRLAMFSMFGFFVQAIVTGKGPIQNLYDHVADPVANNAWAFATNFVPGQ

SEQ ID NO: 501 - DNA, 792 bp, Glycine max
  CDS (1)..(792)
atggcagcagcttcttccatggctctctcatccccatccttggctggcaaggccgtgaagctgggcccatcagccccagaagtgggaagggtgagcatgaggaagaccgtcaccaagcaggtctcctcaggaagcccatggtacggcccagaccgagtcaagtacttgggcccattctctggcgagcccccgtcctacctaaccggtgagttcccaggcgactacggctgggacactgctgggctttccgcagacccagaaaccttcgccaagaaccgtgaactcgaagtgatccactccaggtgggccatgctcggagccttgggctgcgtcttcccggagttgctgtcccgcaacggggtgaagttcggagaagccgtgtggttcaaggccgggtcccagatcttcagcgagggtgggctcgactacttgggcaacccaagcctgatccacgcccagagcatcctcgccatctgggccacacaagttatcctaatgggtgccgttgaaggttaccgtattgctggtggccccctcggtgaggtcactgacccaatctacccaggtggcagcttcgacccattgggccttgctgatgacccagaggcttttgctgagcttaaggtgaaggaactcaagaacggacgattggccatgttctctatgtttggcttctttgttcaggccattgtcaccggaaagggtccattggagaacctcgccgatcaccttgctggacctgtcaacaacaacgcctgggcctatgccaccaacttcgtccccggaaagtga

SEQ ID NO: 502 - protein, 263 aa, Glycine max
MAAASSMALSSPSLAGKAVKLGPSAPEVGRVSMRKTVTKQVSSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWATQVILMGAVEGYRIAGGPLGEVTDPIYPGGSFDPLGLADDPEAFAELKVKELKNGRLAMFSMFGFFVQAIVTGKGPLENLADHLAGPVNNNAWAYATNFVPGK

SEQ ID NO: 503 - DNA, 798 bp, Nicotiana tabacum
  CDS (1)..(798)
atggctacttctgcaattgaacaatctgcatttgctggacagacagctcttaagtcacaaaatgagctcgttaggaagattggtagctttaatggtggacgtgccactatgagacgcaccgttaaaagtgccccgcaaagcatttggtatggagaagataggccaaagtacttgggaccattctccgagcaaactccatcgtacttgactggtgagttcccaggtgattacgggtgggacactgctggactttcagctgacccagagacattcgctaggaaccgtgagcttgaggtgatccattgccgttgggccatgcttggtgctttgggctgtgtattccctgaaatcctttccaagaatggtgttaaattcggtgaggcagtttggttcaaggccggatctcagatattctcagaaggcggtcttgactaccttggtaacccaaaccttatccatgcacagagcattcttgccgtttgggcatcccaagttgtgctcatgggcttaattgaagggtacagagttggtggaggcccacttggtgaaggtcttgacaagatctatcccggaggagcttttgacccacttgggctcgctgatgatcccgaggcattcgctgagttgaaggtgaaggaaatcaagaacggtcgattggctatgttctcaatgtttggtttctttgttcaagctattgtcacaggaaagggaccaattgaaaaccttttcgatcacgttgctgatcctgttgccaacaatgcttgggcttatgctacaaactttgtacccggaaagtga

SEQ ID NO: 504 - protein, 265 aa, Nicotiana tabacum
MATSAIEQSAFAGQTALKSQNELVRKIGSFNGGRATMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGSQIFSEGGLDYLGNPNLIHAQSILAVWASQVVLMGLIEGYRVGGGPLGEGLDKIYPGGAFDPLGLADDPEAFAELKVKEIKNGRLAMFSMFGFFVQAIVTGKGPIENLFDHVADPVANNAWAYATNFVPGK

SEQ ID NO: 505 - DNA, 798 bp, Lycopersicon esculentum
  CDS (1)..(798)
atggccacttgtgcaattcaacaatcagcctttgttggtcaagcagttggtaaatctcaaaatgaatttattaggaaagttggcaacttcggtgaaggccgtattaccatgagacgcactgttaaaagcgctcctcaaagcatctggtacggagaagaccgtcctaagtacttgggcccattttcggagcaaacaccatcctacttaactggggaatttccaggtgattacggatgggacactgctggactctcagctgaccccgagacatttgctagaaaccgtgagcttgaggtgattcattgccgttgggccatgcttggtgctttaggttgtgttttccccgaaatcctttcgaagaacggtgttaaattcggtgaagctgtttggttcaaggctggatctcagattttctccgaaggtgggcttgactaccttggaaacccaaaccttgtccatgctcagagcattcttgctatttgggcttgccaagttgttcttatgggctttgttgaaggatacagagttggtggaggcccacttggtgagggccttgacaagatctacccaggaggtgcctttgacccacttggccttgctgatgatcctgaggcctttgctgaattgaaggtgaaggaaattaagaatggacgtttagctatgttttctatgtttggattctttgttcaagctattgttactggaaagggtccaattgagaacctctctgaccacattaacgaccctgtggctaacaacgcttgggcttacgccacaaactttgtacccggaaagtga

SEQ ID NO: 506 - protein, 265 aa, Lycopersicon esculentum
MATCAIQQSAFVGQAVGKSQNEFIRKVGNFGEGRITMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGSQIFSEGGLDYLGNPNLVHAQSILAIWACQVVLMGFVEGYRVGGGPLGEGLDKIYPGGAFDPLGLADDPEAFAELKVKEIKNGRLAMFSMFGFFVQAIVTGKGPIENLSDHINDPVANNAWAYATNFVPGK

SEQ ID NO: 507 - DNA, 804 bp, Nicotiana tabacum
  CDS (1)..(804)
atggctgcttctacaatggctctttcttccccttcttttgccggaaaggcagtgaaactctcaccgtcttcctctgaaatcaccggaaatgggaaagttaccatgaggaagactgctagcaaggccaagactgtctcttctggtagcccatggtatggtcctgaccgtgtcaagtacttgggcccattctctggtgagtccccaagctacttgactggtgagttccctggtgactacgggtgggacactgctggactttcagctgatccagaaacttttgccaagaatcgtgagttggaggtgatccactgcagatgggccatgcttggagctcttggttgtgtcttccctgagctcttggcacgtaacggtgtcaagtttggcgaggctgtatggttcaaggctggatctcaaatttttagcgagggtggacttgactatttgggcaacccaagtttggtccacgcacaaagcatcttggccatttgggcttgccaagttgtgttgatgggagcagttgagggttaccgtgttgctggtggacctctcggtgaagttgttgacccactttaccctggtggcagtttcgacccattgggacttgctgaagacccagaggcttttgctgagctcaaggtaaaggagatcaagaatggtagacttgctatgttttccatgtttggattctttgttcaggctatcgtcactggaaagggtccattggagaaccttgccgaccaccttgcagacccagttaacaacaatgcctgggcctatgccacaaactttgttcccggaaagtga

SEQ ID NO: 508 - protein, 267 aa, Nicotiana tabacum
MAASTMALSSPSFAGKAVKLSPSSSEITGNGKVTMRKTASKAKTVSSGSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 509 - DNA, 804 bp, Nicotiana tabacum
  CDS (1)..(804)
atggcagctgctacaatggctctctcttcctcttcatttgccggaaaggcagtaaaactctcaccatcttcctctgaaatcactggaaatgggaaagttactatgaggaagactgttaccaaggctaagcctctctcctctggcagcccatggtatggtcctgaccgtgtcaagtacttggggccattctctggtgagtctccaagttacttgacgggtgaattccctggtgactatggatgggacactgctggactttcagctgatccagaaacttttgccaagaatcgtgagttggaggtgatccactgcagatgggctatgcttggagctcttggttgtgtcttccccgagctcttggcccgtaacggggtcaagtttggtgaagcagtatggttcaaggctggatcccaaatttttagcgagggtggacttgactacttgggcaacccaagtttggttcacgcacaaagcatcttggccatttgggcttgccaagttgtgttgatgggagctgtcgaaggttaccgtgttgctggtggccctcttggtgaggttgtcgacccgctctaccccggtggcagctttgacccattgggtcttgctgaagacccagaggcttttgctgaactcaaagtaaaacacatcaagaatggtagacttgctatgttctctatgtttggattcttcgttcaagctatcgtcactggaaagggtccattggagaacctagccgaccaccttgctgacccagttaacaacaatgcctggtcctacgccaccaactttgtccccggaaagtga

SEQ ID NO: 510 - protein, 267 aa, Nicotiana tabacum
MAAATMALSSSSFAGKAVKLSPSSSEITGNGKVTMRKTVTKAKPLSSGSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLAEDPEAFAELKVKHIKNGRLAMFSMFGFFVQAIVTGKGPLENLADHLADPVNNNAWSYATNFVPGK

SEQ ID NO: 511 - DNA, 804 bp, Nicotiana tabacum
  CDS (1)..(804)
atgactgcctctacaatggctctctcttccccttcttttgctggaaatgcagtgaaactctcaccatcttcctctgagatcactggaaatggaaaagctataatgagaaagactgttaccaaggcgaagccagtctcttctggtagcccatggtatggtcctgatcgtgtcaagtacttgggcccattctctggtgaagcaccaagttacttgactggtgagttccctggtgattatgggtgggacactgctggactttcagctgatccagaaacttttgctaagaaccgtgagctagaggtgattcactgtagatgggctatgcttggagctctcggttgtgtcttccccgaactcttggctcgtaatggtgtcaagttcggtgaagctgtctggttcaaggctggatctcaaattttcagcgagggtggacttgactacttgggcaacccaagtttggtccatgcacaaagcatcttggccatttgggcttgccaagttgtgttgatgggagctattgagggttaccgtgttgctggtggacctcttggtgaggttaccgacccactctaccccggtggtagctttgacccattaggtcttgctgatgacccagaggcttttgctgagctcaaggtaaaggagattaaaaacggtaggcttgctatgttctccatgttcggattcttcgttcaagctattgtcactggaaaaggtccattagataaccttgttgatcaccttgctgaccccgttaacaacaacgcctgggcctatgccacaaactttgtccccggaaagtaa

SEQ ID NO: 512 - protein, 267 aa, Nicotiana tabacum
MTASTMALSSPSFAGNAVKLSPSSSEITGNGKAIMRKTVTKAKPVSSGSPWYGPDRVKYLGPFSGEAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAIEGYRVAGGPLGEVTDPLYPGGSFDPLGLADDPEAFAELKVKEIKNGRLAMFSMFGFFVQAIVTGKGPLDNLVDHLADPVNNNAWAYATNFVPGK

SEQ ID NO: 513 - DNA, 807 bp, Pisum sativum
  CDS (1)..(807)
atggccgcttcatccatggctctctcttccccaaccttgactggcaagccagtcgaaacatccgcaaacccatcaagccaagaattgggaggtgcaaggttcaccatgaggaagtctgctaccaccaagaaagtagcctcctctggaagcccatggtacggaccagaccgtgttaagtacttaggcccattctccggtgagtctccgtcctacttgactggagagttccccggtgactacggttgggacactgccggactctctgctgacccagagacattctccaagaaccgtgagcttgaagtcatccactccagatgggctatgttgggtgctttgggatgtgtcttcccagagcttttgtctcgcaacggtgttaaattcggtgaagctgtgtggttcaaggcaggatctcaaatctttagcgagggtggacttgactacttgggtaacccaagcttggtccatgcacaaagcatccttgccatctgggctactcaagttatcttgatgggagctgtcgaaggttaccgtattgccggtgggcctcttggtgaggtggttgacccactttacccaggtggtagctttgatccattgggcttagctgacgacccagaagcattcgcagaattgaaggtgaaggaactcaagaacggtagattagctatgttctctatgtttggattctttgttcaagctattgtgaccggaaagggacctttggagaatcttgctgatcatctttccgacccagttaacaacaatgcatggtcatatgccaccaactttgttcccggaaagtga

SEQ ID NO: 514 - protein, 268 aa, Pisum sativum
MAASSMALSSPTLTGKPVETSANPSSQELGGARFTMRKSATTKKVASSGSPWYGPDRVKYLGPFSGESPSYLTGEFPGDYGWDTAGLSADPETFSKNRELEVIHSRWAMLGALGCVFPELLSRNGVKFGEAVWFKAGSQIFSEGGLDYLGNPSLVHAQSILAIWATQVILMGAVEGYRIAGGPLGEVVDPLYPGGSFDPLGLADDPEAFAELKVKELKNGRLAMFSMFGFFVQAIVTGKGPLENLADHLSDPVNNNAWSYATNFVPGK

SEQ ID NO: 515 - DNA, 798 bp, Zea mays
  CDS (1)..(798)
atggcgagcagcaccatggccctctcctccacagccttcgccggcaaggccgtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccactgtccggcgagcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcacgttcgacccgctcggcctcgccgacgaccctgaggccttcgcggacgtcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtga

SEQ ID NO: 516 - protein, 265 aa, Zea mays
MASSTMALSSTAFAGKAVNVPSSLFGEARVTMRKTAAKAKPAASSGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAIEGYRVAGGPLGEVVDPLYPGGTFDPLGLADDPEAFADVKVKELKNGRLAMFSMFGFFVQAIVTGKGPLENLADHLADPVNNNAWAYATNFVPGK

SEQ ID NO: 517 - DNA, 804 bp, Spinacia oleracea
  CDS (1)..(804): transl_table=11
atggcttcctccactatggctctctcttccccttctcttgccgggaaggctgtaaagctcggcccaaccgcctcggaaatcattggtgagggaaggatcaccatgaggaagactgcaggaaagcccaaaactgttcaatcaagcagcccatggtacggcccagaccgtgttaagtacttgggcccattctccggtgagagcccatcatacctcaccggtgagttccctggtgactacggttgggacactgctgggctttcagctgacccagaaaccttcgctaagaaccgtgagcttgaagttatccactgcaggtgggctatgttgggagcattgggttgtgttttcccagagctcttggcccgtaatggtgttaagttcggtgaggccgtttggtttaaggcgggttcacaaatctttagcgagggtgggcttgactacttgggtaacccaagtttggtccatgctcaaagtatccttgctatttgggcctgtcaagttatcttgatgggtgctgttgaggggtaccgtattgctggtgggcctcttggtgaggtggttgacccactttaccctggtggtagctttgacccattgggcttggctgatgacccagaagccttcgctgagttgaaggtgaaggaaattaagaatggtaggttggctatgttttccatgtttgggttctttgttcaagctattgttaccggaaagggcccattggaaaacctcgctgaccaccttgctgacccggttaacaacaatgcttggaactttgccaccaactttgtccccggaaagtga

SEQ ID NO: 518 - protein, 267 aa, Spinacia oleracea
MASSTMALSSPSLAGKAVKLGPTASEIIGEGRITMRKTAGKPKTVQSSSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVILMGAVEGYRIAGGPLGEVVDPLYPGGSFDPLGLADDPEAFAELKVKEIKNGRLAMFSMFGFFVQAIVTGKGPLENLADHLADPVNNNAWNFATNFVPGK

SEQ ID NO: 519 - DNA, 798 bp, Lycopersicon esculentum
  CDS (1)..(798)
atggcagctgctacaatggctctttcttccccttcatttgctggacaggcagtcaaactctcaccatctgcctcagaaatttctggaaatggaaggatcactatgagaaaggctgttgccaagtccgccccatctagcagcccatggtatggccctgaccgtgttaagtacttgggcccattctctggtgagtccccaagctacttgaccggtgaatttcctggtgattacgggtgggataccgctggactttcagcagaccctgaaacttttgccaagaaccgtgaacttgaagtgatccactgcagatgggctatgcttggtgctcttggatgtgtcttccctgagctcttggcccgtaatggtgtcaagttcggtgaggctgtgtggttcaaggccggatcccagatcttcagtgaaggtggacttgactacttgggcaacccaagcttggtccatgcacaaagcatcttggccatctgggcttgccaagttgtgttgatgggagctgttgagggttaccgtattgctggtggacctcttggtgaggttgtcgacccactctaccctggtggcagcttcgacccattaggccttgctgaagacccagaggcatttgctgagctcaaggtaaaggagatcaagaacggtagacttgctatgttctctatgtttggattctttgttcaagctattgtcaccggaaagggtccattggagaaccttgctgatcaccttgcagaccccgtaaacaacaatgcctgggctttcgccacaaactttgtccccggaaaatga

SEQ ID NO: 520 - protein, 265 aa, Lycopersicon esculentum
MAAATMALSSPSFAGQAVKLSPSASEISGNGRITMRKAVAKSAPSSSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRIAGGPLGEVVDPLYPGGSFDPLGLAEDPEAFAELKVKEIKNGRLAMFSMFGFFVQAIVTGKGPLENLADHLADPVNNNAWAFATNFVPGK

SEQ ID NO: 521 - DNA, 795 bp, Zea mays
  CDS (1)..(795)
atggctgccgccaccatggctatcacctcccgcgcgctcgtcggcaagccggcggctggcacgagggacgtcttcggcgagggccgcatcaccatgcgcaagaccgccgccaagcccaagccggcgcgctccggcagcccctggtacggtgccgaccgcgtcctgtacctgggcccgctgtccggctcacctccgagctacctgaccggcgagttccccggcgactacgggtgggacaccgaggggctgtcggcggacccggagaccttcgccaagaaccgcgagctggaggtgatccactgccgctgggccatcgcggtagggctcgggtgcgtgttcccggagctgctcgcccgcaacggcgtcaagttcggcgagggggtgtggttcaaggcgggctcccagatcttcagcgagggcgggctcagtcatcccggcaacccgagccttgtccacgcgcagagcatcctggctatctgggcgtgccaggtggtgctcatgggcgccgtcgaggggtaccatgtcgccggcggccggctcggggaggtggtcgacccgctgtacctgggcggcagcttcgacccgctcgggctcggcgacgacccggagcggttcgccgagctcaaggtgaaggagatcaagaacggccgcctcgccatgttctccatgttcggcttcttcgtgcaggctatcgtcaccggcaagggccccatcgagaacctcgccgaccacctcaccgaccccgtcaacaacaacgcctgggcttacgccaccaacttcgtccccggcaagtga

SEQ ID NO: 522 - protein, 264 aa, Zea mays
MAAATMAITSRALVGKPAAGTRDVFGEGRITMRKTAAKPKPARSGSPWYGADRVLYLGPLSGSPPSYLTGEFPGDYGWDTEGLSADPETFAKNRELEVIHCRWAIAVGLGCVFPELLARNGVKFGEGVWFKAGSQIFSEGGLSHPGNPSLVHAQSILAIWACQVVLMGAVEGYHVAGGRLGEVVDPLYLGGSFDPLGLGDDPERFAELKVKEIKNGRLAMFSMFGFFVQAIVTGKGPIENLADHLTDPVNNNAWAYATNFVPGK

SEQ ID NO: 523 - DNA, 1012 bp, Brassica napus
  CDS (86)..(886)
cgggaatcggccttatggtcggggggactctcaccggtcacaaaaaaaaaaacataaaaacaaaaaaagaagaagaaaagttctaatggctgcctcaaccatggctctgtcctccctcgccttagccggaaaggctgtgaagctctcaccaggagcctccgaagtgtttggaaccgcccgtgtcaccatgcgcaaaaccgtcaaacccaccggtccatcaggcagcccatggtacggatccgacagggttaagtacttgggtccattctccggcgagcccccaagctacctcaccggagagttccccggtgactacggatgggacaccgctggtctatccgctgacccggagacctttgcaagaaaccgtgagctagaagttatccactgcagatgggccatgcttggagccctaggatgcgttttccctgagctattggctcgtaacggagtgaagttcggagaggctgtttggttcaaggccggttcgcagatcttcagcgaaggagggctcgactacttgggcaacccgagcttggtccacgctcagagcatcttagccatttgggctactcaggtgatcctcatgggagctgttgagggttacagagtcgctggagacggaccattgggagaagcagaggacttgttatacccaggtggtagcttcgacccattgggcctcgctgctgacccagaagcgttcgcggagttgaaggtgaaggagatcaagaacggaaggttggctatgttctccatgtttggattcttcgttcaggcaatcgttaccggaaagggaccgttggagaatctcgctgaccatttggctgatccagtcaacaacaacgcatgggctttcgccaccaacttcgtccccggaaagtgagcgagttgaagcttagcaagagaaagagagttcgtttgtgatgtttcttttaagtaaatttgtgaaatttccattgtcgtaccattgtattatttatcagacattgaacctctttttctcaactca

SEQ ID NO: 524 - protein, 266 aa, Brassica napus
MAASTMALSSLALAGKAVKLSPGASEVFGTARVTMRKTVKPTGPSGSPWYGSDRVKYLGPFSGEPPSYLTGEFPGDYGWDTAGLSADPETFARNRELEVIHCRWAMLGALGCVFPELLARNGVKFGEAVWFKAGSQIFSEGGLDYLGNPSLVHAQSILAIWATQVILMGAVEGYRVAGDGPLGEAEDLLYPGGSFDPLGLAADPEAFAELKVKEIKNGRLAMFSMFGFFVQAIVTGKGPLENLADHLADPVNNNAWAFATNFVPGK

SEQ ID NO: 525 - DNA, 1093 bp, Brassica napus
  CDS (56)..(856)
tccaattcattacaagttatctaaaaactttaacttgcaccacactctaacagcaatggccgcctctacaatggctctatcctctcccgctttggccggaaaggccgtgaagcttgctcccgcagcctctgaagtctttggaaccggccgagtcaccatgcgcaaaaccaccaaaccagccggcccatctggcagcccatggtacggatccgacagggttaagtacttgggtccattctccggagagcccccgagctacctcaccggagagttcccaggcgactacggatgggacaccgctggtctatccgctgaccccgagaccttcgcaagaaaccgtgagctagaagttatccactgcagatgggccatgctcggagccctaggctgcgtttttcctgaactcttggcccgtaacggagtgaagttcggagaagcggtttggttcaaggccggttcacagatcttcagcgaaggtgggctcgactatttgggcaacccgagcttggtccacgctcagagcatcttagccatttgggccactcaagtgatcctcatgggggctgttgagggttacagagtcgctggagacggaccattgggagaagcggaggacttgttatacccagggggtagcttcgacccgttgggcctcgctgctgacccagaagcgttcgcggagttgaaggtgaaggagatcaagaacggaaggttggctatgttctccatgtttggattcttcgttcaggccattgtcaccggaaagggaccgttggagaatctcgctgaccatttggctgatccagtcaacaacaacgcatgggccttcgccaccaacttcgtccccggaaagtgagtttaatttgtgatcgtgttgtgtgtatccggtttgttaaatcttgaatgtgatataaaaacttaaaatgttatgaaatatttattataaatttgatgatattgatggatcaaaaaaaaaaaaaaaaaaaaaaaaaaaaaaaaaaaaaaaaaaattttttttaaaaaaaaaaaaaacggggggcgcttaaaaaaaaccaaatttaggcccgggggggggaaaaaatatttttttttt

SEQ ID NO: 526 - protein, 266 aa, Brassica napus
MAASTMALSSPALAGKAVKLAPAASEVFGTGRVTMRKTTKPAGPSGSPWYGSDRVKYLGPFSGEPPSYLTGEFPGDYGWDTAGLSADPETFARNRELEVIHCRWAMLGALGCVFPELLARNGVKFGEAVWFKAGSQIFSEGGLDYLGNPSLVHAQSILAIWATQVILMGAVEGYRVAGDGPLGEAEDLLYPGGSFDPLGLAADPEAFAELKVKEIKNGRLAMFSMFGFFVQAIVTGKGPLENLADHLADPVNNNAWAFATNFVPGK

SEQ ID NO: 527 - DNA, 1157 bp, Brassica napus
  CDS (87)..(890)
gtcccgggattcggccttatggccggggactctcaccagtcacaaaaaaaaacccataaaatcaacaaaaaagaagaaacgttctaatggctgcctcaaccatggctctctcctcccctgccttcgccggaaaggccgtgaagctttctccttcagcatcagaagtccttggaagcggccgtgtgacaatgaggaagaccgtcgccaagccaaagggcccatcgggcagcccatggtacggttccgaaagagtcaagtacctaggtccattctctggcgagccaccgagctaccttaccggagagttccctggtgactacggatgggacaccgccggtctatcagccgaccccgagaccttcgccaggaaccgtgagctagaagttatccactgcaggtgggccatgctcggagccctaggctgcgttttccctgagctcttggctcgtaacggagtcaagttcggagaagcggtttggttcaaggctggttcacagatcttcagcgaaggaggactcgactacttgggcaacccgagcttggtccacgctcagagcatcttagccatttgggctactcaggtgatcctcatgggagctgttgagggttacagagttgccggagagggaccattgggagaggccgaggacttgctttacccaggaggcagctttgacccattgggtctcgctaccgacccagaagctttcgccgagttgaaggtgaaggagatcaagaacggaaggttggctatgttctctatgtttggattctttgtccaggctattgtcactggaaagggaccgttggagaatctcgccgaccatttggctgatccagtcaacaacaacgcatgggccttcgccaccaacttcgtccccggaaagtgaagcttatgtgagtgagagccagagaaagagaagtttgtttgtggtctttcctatgtaaatttgtgcaatttcctttgtcgtatctttgtatgattcatcagaaatcgaacctctttttctcaaaaaaaaaaaaaaaaaaagcggccgttttaaaggatccaagtttacgaacccgggcatgcaaggtaatactttttttatagggccccctaaattcatttcattggcggtggtttaacaccgtcgggacgggaaaacccttggggt

SEQ ID NO: 528 - protein, 267 aa, Brassica napus
MAASTMALSSPAFAGKAVKLSPSASEVLGSGRVTMRKTVAKPKGPSGSPWYGSERVKYLGPFSGEPPSYLTGEFPGDYGWDTAGLSADPETFARNRELEVIHCRWAMLGALGCVFPELLARNGVKFGEAVWFKAGSQIFSEGGLDYLGNPSLVHAQSILAIWATQVILMGAVEGYRVAGEGPLGEAEDLLYPGGSFDPLGLATDPEAFAELKVKEIKNGRLAMFSMFGFFVQAIVTGKGPLENLADHLADPVNNNAWAFATNFVPGK

SEQ ID NO: 529 - DNA, 936 bp, Brassica napus
  CDS (60)..(863)
cgggtcgacgatttcgtaaaaaaaacacataaaatcaacaaaaaagaagaaacgttctaatggctgcctcaacaatggctctctcctcccctgccttcgccggaaaggccgtgaagctttctccttcagcatcagaagtccttggaagcggccgtgtgacaatgaggaagaccgtcgccaagccaaagggcccatcaggcagcccatggtacggttccgaaagagtcaagtacttaggtccattctctggtgagccaccaagctaccttaccggagagttccccggagactacggatgggacacagccggtctatcagccgaccccgagacattcgccaggaaccgtgagctagaagttatccactgcaggtgggccatgctcggagccctaggctgcgttttccctgagctcttggctcgtaacggagtcaagttcggagaagccgtttggttcaaggctggttcacagatcttcagcgaaggaggactcgactacttgggcaacccgagcttggtccacgctcagagcatcttagccatttgggccactcaggtgattctcatgggagctgttgagggttacagagtcgctggagacggaccattgggagaagcagaggacttgttatacccgggtggtagcttcgacccattgggcctcgctgctgacccagaggctttcgcagagttgaaggtgaaggagatcaagaacggaaggttggctatgttctccatgtttggattctttgtacaggccatcgtcactggaaagggacctttggagaatcttgctgaccatttggctgatccagtcaacaacaacgcatgggcctttgctaccaacttcgtccctggaaagtgattttaattggtgatcgtgttgtgtgtatccggtttgttaaatcttgaatgtgatgtaaaagcttaaaatgttt

SEQ ID NO: 530 - protein, 267 aa, Brassica napus
MAASTMALSSPAFAGKAVKLSPSASEVLGSGRVTMRKTVAKPKGPSGSPWYGSERVKYLGPFSGEPPSYLTGEFPGDYGWDTAGLSADPETFARNRELEVIHCRWAMLGALGCVFPELLARNGVKFGEAVWFKAGSQIFSEGGLDYLGNPSLVHAQSILAIWATQVILMGAVEGYRVAGDGPLGEAEDLLYPGGSFDPLGLAADPEAFAELKVKEIKNGRLAMFSMFGFFVQAIVTGKGPLENLADHLADPVNNNAWAFATNFVPGK

SEQ ID NO: 531 - DNA, 1089 bp, Brassica napus
  CDS (64)..(867)
cgggtcgacgatttcgtaaaaaactaataaacgttttgtacaaaaaaacagcaaggaaacgcaatggctgcctcgacaatggctctctcctcctctgccttcgccggaaaggccgtgaacctttctccagcggcatcagaagtcctcggaagtggccgtgtgacaatgaggaagaccgtggccaagccaaagggaccatcaggcagcccatggtacggagccgagagagtcaagtacttgggtccattctccggcgagccaccgagctaccttaccggagagttcccaggagactacgggtgggacacagccggtctctcagccgatcccgagacattcgcaaggaaccgtgagctagaagttatccactgcaggtgggccatgctcggagccctaggctgcgtcttcccggagttgctggccaggaatggagtcaagttcggagaggcggtttggttcaaggctggctcacagatcttcagcgacggaggactcgactacttgggaaacccaagcttggttcacgctcagagcattttggctatttgggctactcaagtgatcttgatgggagccgttgaaggttacagagttgcaggaaacgggcccttgggagaggccgaggacttgctctacccaggaggcagcttcgacccattgggcttggctaccgacccagaggctttcgcggagttgaaggtgaaggaggtcaagaacggaagattggctatgttctctatgtttggattctttgttcaagccattgtcactggtaagggacccttggagaaccttgctgaccatcttgctgatccagtcaacaacaacgcatgggccttcgccaccaacttcgttcccggaaagtgagccaagttcttatcagtatttgcttcagtatgagtgtaataagagaaagagagagatgttgtttagatgtaaaacttgcaagtctttgtatgatttactaattaatcaaataactctttttccccaaaaaaaaaaaaaaaaaaaaaaaaaaaaaaaaggaaaaaaaaaaaaatacgcgggccccctttttaaaaatttttctatagggccccctaaattcaa

SEQ ID NO: 532 - protein, 267 aa, Brassica napus
MAASTMALSSSAFAGKAVNLSPAASEVLGSGRVTMRKTVAKPKGPSGSPWYGAERVKYLGPFSGEPPSYLTGEFPGDYGWDTAGLSADPETFARNRELEVIHCRWAMLGALGCVFPELLARNGVKFGEAVWFKAGSQIFSDGGLDYLGNPSLVHAQSILAIWATQVILMGAVEGYRVAGNGPLGEAEDLLYPGGSFDPLGLATDPEAFAELKVKEVKNGRLAMFSMFGFFVQAIVTGKGPLENLADHLADPVNNNAWAFATNFVPGK

SEQ ID NO: 533 - DNA, 1521 bp, Glycine max
  CDS (67)..(864)
tttttttttttaattcagaattaaagtagcaaagaaaaaaaaaaacccgtaaacaacaccatcatcatggccacctctgctattcagcaatcagcattcgcaggtcaaactgctctgaagcagctcaatgagttggtccgcaagaccggtggcgccggcaaaggtcgcaccaacatgcgccgtaccgtcaagagtgctcctcagagcatttggtatggccctgatcgtcccaagtacctgggtccattctcagagcagattccgtcatacctgaccggagaattccccggtgactacggatgggacactgctggactatcagctgacccggaaaccttcgccaggaaccgggagctggaggtgattcacagcagatgggccatgcttggtgcacttggctgcaccttcccagagatccttgagaagaatggtgtgaaattcggcgaggccgtgtggttcaaggctggttcacagatcttctcggagggaggacttgactacttgggcaacccaaacctgatccatgctcaaagcatccttgccatctgggctgttcaggttgtgctcatgggttttgttgaaggttacagagttggtggaggaccccttggtgaaggacttgaccctatctaccctggtggtgcatttgaccctcttggtctggctgatgaccctgatgcattcgctgagttgaaggtcaaggaactcaagaacggtcgcttggctatgttctccatgtttggtttctttgttcaggccattgtcactggcaagggccctattcagaacctttacgaccatgttgctgatcctgttgccaacaatgcttgggcttatgccactaactttgtccctggacaatgagcattgcaattcaatgcaatcttctgctcccattttctctaatgtaactacacctgtgtaccagaagaatctgtatgagaaccattatattatatatattagaaatttctgtccctaaaaaaaaaaaaaaaaaaaaaaaaaaaaaaaaaaaaaaaaaaaaaaaaaaacaaattcggcacgaggaaatagttaggagggcatggaagagatacaatttgagcttaggtcttggactgaacaaagttgctgggaaggttttcagaattggacatcttggccacttgaatgagttgcaactgttgggatgtctagctggtgtagagatgatactcaaagatgtgggttatcctgtaaagcttggaagtggagttgctgctgccagtgcatacttacagaacactattcctatgatcccttccaggatttgagtcacaaatcattcttgtctttacttcctttttctgctctttcagaaattctgtaaaatatatattaccctcttttacactcctttgaagatgaacgtactttctactttcagctttaatgcattgcttcttttattgtcctgtatatcaaaaatcattgcatcttatgaccttatttgtcactgtgttatggtaatcaaattcatcagcaggggttattggattgcaa

SEQ ID NO: 534 - protein, 265 aa, Glycine max
MATSAIQQSAFAGQTALKQLNELVRKTGGAGKGRTNMRRTVKSAPQSIWYGPDRPKYLGPFSEQIPSYLTGEFPGDYGWDTAGLSADPETFARNRELEVIHSRWAMLGALGCTFPEILEKNGVKFGEAVWFKAGSQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIQNLYDHVADPVANNAWAYATNFVPGQ

SEQ ID NO: 535 - DNA, 1015 bp, Glycine max
  CDS (73)..(867)
gcacgaggctaaccattctctgcacttttcagttacaaagcatttcattgttttacaatatacaacactacaatggctgcttcaacaatggctctctcttcatcatcattggctggccaagctatcaagcttgccccctccacccctcagcttggtgttggaagggttagcatgagaaaaacagcctccaagactgttacctcaggaagcccatggtacggcccagatcgtgtcaagtacttgggcccattctctggtgagcccccatcctacctcactggtgaattcccaggtgactatggttgggacactgctgggctttctgctgacccagagacctttgccaaaaaccgtgaactggaagtcatccactccagatgggccatgttgggagccttgggctgtgttttccctgaactcttgtcccgcaacggagtcaagtttggtgaggccgtgtggttcaaggccgggtctcagatattcagtgagggcgggcttgactacttgggcaacccaagcctgatccatgcacaaagcattcttgccatctgggccacccaagttatcttgatgggtgcagttgagggttaccgtattgctggtgggcctcttggtgaggtgactgatccaatctatccaggtggcagctttgacccattgggtcttgctgatgacccagaggcttttgctgagctgaaggtgaaggagctcaagaatggtaggttggccatgttctccatgtttggattctttgttcaggcaattgtgacaggaaagggacccttagaaaaccttgctgatcaccttgctgacccagtgaacaacaatgcttgggcctatgccacaaactttgtccccggaaagtgagggaaaaaaaaaaaacctgaaacgatgagaaactatgacttgagtgtgaatttcatgttgttatttaatgaaatatatattggatgtgtgccttataaaaaaaaaaaaaaaaaaaaaaaaaaaaaaaaaaaaaaaaaaaaaaaaaaaa

SEQ ID NO: 536 - protein, 264 aa, Glycine max
MAASTMALSSSSLAGQAIKLAPSTPQLGVGRVSMRKTASKTVTSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLIHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 537 - DNA, 1028 bp, Glycine max
  CDS (115)..(909)
actcgagccgaatcggctcgagcaggaaagggaccaaacatggagaccatggccaacttacaattctcttcacttttaagttaaatagtttttcattgtttcatttaatctacaatggctgcttcaacaatggctctctcttcatcatcattggctggccaagctatcaagcttgccccctccacccctcagcttggtgttggaagggttagcatgaggaaaacagcctccaagactgtttcttctggaagcccatggtacggcccagaccgtgtcaagtacttgggcccattctctggtgagcccccatcctacctcactggtgaattcccaggtgactatggttgggacactgctgggctttctgctgacccagagacctttgccaagaaccgtgaacttgaagtcatccactccagatgggccatgttgggagccctgggctgtgttttccccgaactcttggcccgcaacggtgtcaagttcggtgaagccgtgtggttcaaggccgggtctcagatattcagtgagggtgggcttgactacttgggcaacccaagcctgatccatgcacaaagcattcttgccatctgggccacccaagttatcttgatgggtgccgttgagggttaccgtattgctggtgggcctcttggtgaggtgactgacccaatctatccaggtggcagctttgacccattgggccttgctgatgacccagaggcttttgctgagttgaaggtgaaagagctcaagaatggtaggttggccatgttctccatgtttggtttctttgttcaggcaattgtgacaggaaagggacctttggaaaatcttgctgaccacctagctgacccagtaaacaataatgcctgggcctatgctacaaactttgtccccggaaagtgagcatagcaatagtgaaacaaagagaaacacagtgacttgaaaattagagtgagagtttcattgttatttggagaaatacatattgaatgttttcttttaagaagaatatgaattatata

SEQ ID NO: 538 - protein, 264 aa, Glycine max
MAASTMALSSSSLAGQAIKLAPSTPQLGVGRVSMRKTASKTVSSGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWATQVILMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 539 - DNA, 950 bp, Glycine max
  CDS (38)..(835)
caaagaaaaaaaaaaacccttagccaacacaaccatcatggccacctctgctattcagcaatcagcattcgctggtcaaactgctctgaagcagctcaatgagttcgtccgcaagaccggtggcgccggcaaaggtcgcactaacatgcgccgcaccgtcaagagtgctcctcagagcatttggtatggccctgatcgtcccaagtacctgggtccattctcggagcagattccatcatacctgaccggagaattccctggtgactacggatgggacactgctggattatcagctgacccggaaaccttcgccaggaaccgggagctggaggtgattcacagcagatgggcaatgcttggtgcccttggctgcaccttcccagagatccttgagaagaatggtgtcaaattcggcgaggccgtgtggttcaaggctggttcacagatcttctcagagggaggacttgactacttgggcaacccaaacctgatccatgctcagagcatccttgctatctgggctgttcaggttgtgctcatgggttttgttgaaggttacagagttggtggaggaccccttggtgaaggacttgaccctatctaccctggtggtgcatttgaccctcttggtctggctgatgaccctgatgcattcgctgagttgaaggtcaaggaactcaagaacggtcgcttggctatgttctccatgtttggtttctttgttcaggccattgtcactggcaagggccctattcagaacctttacgaccatgttgctgatcctgttgccaacaatgcttgggcttatgccactaactttgtccctggacaatgagcattgcaattcaatgcaatcttctgctcccattttctctaatgtaactacacctgtgtaccagaagaatctgtatgagaaccattatattatatatattagaaatttctgtccc

SEQ ID NO: 540 - protein, 265 aa, Glycine max
MATSAIQQSAFAGQTALKQLNEFVRKTGGAGKGRTNMRRTVKSAPQSIWYGPDRPKYLGPFSEQIPSYLTGEFPGDYGWDTAGLSADPETFARNRELEVIHSRWAMLGALGCTFPEILEKNGVKFGEAVWFKAGSQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIQNLYDHVADPVANNAWAYATNFVPGQ

SEQ ID NO: 541 - protein, 279 aa, Artificial sequence
  Description of artificial sequence: consensus sequence
  Variant (3)..(5): Xaa in position 3 to 5 is any amino acid
  Variant (6)..(11): Xaa in position 6 to 11 is any or no amino acid
  Variant (13)..(28): Xaa in position 13 to 28 is any amino acid
  Variant (29)..(37): Xaa in position 29 to 37 is any or no amino acid
  Variant (39)..(40): Xaa in position 39 to 40 is any amino acid
  Variant (43)..(43): Xaa in position 43 is any amino acid
  Variant (44)..(55): Xaa in position 44 to 55 is any or no amino acid
  Variant (57)..(57): Xaa in position 57 is any amino acid
  Variant (61)..(61): Xaa in position 61 is any amino acid
  Variant (64)..(64): Xaa in position 64 is any amino acid
  Variant (72)..(74): Xaa in position 72 to 74 is any amino acid
  Variant (102)..(102): Xaa in position 102 is any amino acid
  Variant (111)..(111): Xaa in position 111 is any amino acid
  Variant (126)..(126): Xaa in position 126 is any amino acid
  Variant (128)..(129): Xaa in position 128 to 129 is any amino acid
  Variant (130)..(130): Xaa in position 130 is any or no amino acid
  Variant (145)..(145): Xaa in position 145 is any amino acid
  Variant (161)..(161): Xaa in position 161 is any amino acid
  Variant (163)..(163): Xaa in position 163 is any amino acid
  Variant (174)..(174): Xaa in position 174 is any amino acid
  Variant (177)..(177): Xaa in position 177 is any amino acid
  Variant (181)..(181): Xaa in position 181 is any amino acid
  Variant (182)..(182): Xaa in position 182 is any or no amino acid
  Variant (188)..(189): Xaa in position 188 to 189 is any amino acid
  Variant (191)..(192): Xaa in position 191 to 192 is any amino acid
  Variant (193)..(193): Xaa in position 193 is any or no amino acid
  Variant (197)..(198): Xaa in position 197 to 198 is any amino acid
  Variant (200)..(200): Xaa in position 200 is any amino acid
  Variant (201)..(201): Xaa in position 201 is any or no amino acid
  Variant (206)..(206): Xaa in position 206 is any amino acid
  Variant (207)..(207): Xaa in position 207 is any or no amino acid
  Variant (215)..(215): Xaa in position 215 is any amino acid
  Variant (228)..(228): Xaa in position 228 is any amino acid
  Variant (253)..(253): Xaa in position 253 is any amino acid
  Variant (257)..(257): Xaa in position 257 is any amino acid
  Variant (260)..(260): Xaa in position 260 is any amino acid
  Variant (265)..(265): Xaa in position 265 is any amino acid
  Variant (271)..(271): Xaa in position 271 is any amino acid
MAXXXXXXXXXSXXXXXXXXXXXXXXXXXXXXXXXXXRXXMRXXXXXXXXXXXXXSXWYGXDRXKYLGPFSXXXPSYLTGEFPGDYGWDTAGLSADPETFAXNRELEVIHXRWAMLGALGCVFPEXLXXXNGVKFGEAVWFKAGXSQIFSEGGLDYLGNPXLXHAQSILAIWAXQVXLMGXXVEGYRXXGXXXLGEXXDXXYPGGXXFDPLGLAXDPEAFAELKVKEXKNGRLAMFSMFGFFVQAIVTGKGPXENLXDHXADPVXNNAWAXATNFVPGK

SEQ ID NO: 542 - protein, 45 aa, Artificial sequence
  Description of artificial sequence: amino acid sequence pattern comprised in a variant of SEQ ID NO: 322
  Variant (18)..(18): Xaa in position 18 is Lys or Arg
  Variant (27)..(27): Xaa in position 27 is Cys or Ser
  Variant (38)..(38): Xaa in position 38 is Thr or Val
  Variant (42)..(42): Xaa in position 42 is any or no amino acid
  Variant (44)..(44): Xaa in position 44 is any amino acid
  Variant (45)..(45): Xaa in position 45 is Lys or Arg
DYGWDTAGLSADPETFAXNRELEVIHXRWAMLGALGCXFPEXLXX

SEQ ID NO: 543 - protein, 59 aa, Artificial sequence
  Description of artificial sequence: amino acid sequence pattern comprised in a variant of SEQ ID NO: 322
  Variant (2)..(2): Xaa in position 2 is any amino acid
  Variant (9)..(9): Xaa in position 9 is Ile, Leu or Val
  Variant (34)..(34): Xaa in position 34 is Ile, Leu or Val
  Variant (38)..(38): Xaa in position 38 is any amino acid
  Variant (41)..(41): Xaa in position 41 is Ile, Leu or Val
  Variant (42)..(42): Xaa in position 42 is Ala, Asp, Asn, Ser or Thr
  Variant (43)..(43): Xaa in position 43 is Asp or Gly
  Variant (46)..(46): Xaa in position 46 is Ala or Asn
  Variant (51)..(51): Xaa in position 51 is Ala, Asn, Ser or Val
  Variant (52)..(52): Xaa in position 52 is Phe or Tyr
  Variant (55)..(55): Xaa in position 55 is any amino acid
  Variant (57)..(57): Xaa in position 57 is Ala or Val
FXELKVKEXKNGRLAMFSMFGFFVQAIVTGKGPXENLXDHXXXPVXNNAWXXATXFXPG

SEQ ID NO: 544 - protein, 22 aa, Artificial sequence
  Description of artificial sequence: amino acid sequence pattern comprised in a variant of SEQ ID NO: 322
  Variant (4)..(4): Xaa in position 4 is Ala, Pro or Ser
  Variant (7)..(7): Xaa in position 7 is Pro or Val
  Variant (8)..(8): Xaa in position 8 is any amino acid
  Variant (13)..(13): Xaa in position 13 is Phe or Leu
  Variant (15)..(15): Xaa in position 15 is any or no amino acid
  Variant (17)..(18): Xaa in position 17 to 18 is any or no amino acid
WYGXDRXXYLGPXSXEXXPSYL

SEQ ID NO: 545 - protein, 11 aa, Artificial sequence
  Description of artificial sequence: amino acid sequence pattern comprised in a variant of SEQ ID NO: 322
NGVKFGEAVWF

SEQ ID NO: 546 - protein, 12 aa, Artificial sequence
  Description of artificial sequence: amino acid sequence pattern comprised in a variant of SEQ ID NO: 322
  Variant (8)..(8): Xaa in position 8 is any or no amino acid
  Variant (10)..(10): Xaa in position 10 is any or no amino acid
  Variant (12)..(12): Xaa in position 12 is Asp or Glu
FDPLGLAXDXPX

SEQ ID NO: 547 - protein, 15 aa, Artificial sequence
  Description of artificial sequence: amino acid sequence pattern comprised in a variant of SEQ ID NO: 322
  Variant (2)..(2): Xaa in position 2 is Ile or Val
  Variant (3)..(3): Xaa in position 3 is Phe or Leu
  Variant (6)..(6): Xaa in position 6 is any amino acid
  Variant (12)..(12): Xaa in position 12 is Ile or Val
  Variant (13)..(13): Xaa in position 13 is Ala, Gly or Pro
  Variant (15)..(15): Xaa in position 15 is Asp, Glu, Gly or Asn
VXXMGXVEGYRXXGX

SEQ ID NO: 548 - protein, 11 aa, Artificial sequence
  Description of artificial sequence: amino acid sequence pattern comprised in a variant of SEQ ID NO: 322
  Variant (5)..(5): Xaa in position 5 is Ala, Gly or Val
  Variant (6)..(6): Xaa in position 6 is any amino acid
  Variant (8)..(10): Xaa in position 8 to 10 is any or no amino acid
PLGEXXDXXXP

SEQ ID NO: 549 - protein, 24 aa, Artificial sequence
  Description of artificial sequence: amino acid sequence pattern comprised in a variant of SEQ ID NO: 322
  Variant (2)..(2): Xaa in position 2 is Ala, Asp, Glu, Gly, Ser or Thr
  Variant (3)..(3): Xaa in position 3 is Trp or Tyr
  Variant (5)..(5): Xaa in position 5 is Asp, Asn or Thr
  Variant (6)..(6): Xaa in position 6 is Gly or Ser
  Variant (7)..(7): Xaa in position 7 is Asp, Glu, Gln, Ser or Thr
  Variant (8)..(9): Xaa in position 8 to 9 is any amino acid
  Variant (11)..(18): Xaa in position 11 to 18 is any or no amino acid
  Variant (20)..(20): Xaa in position 20 is Ala, Gly or Ser
  Variant (21)..(22): Xaa in position 21 to 22 is any amino acid
  Variant (23)..(23): Xaa in position 23 is Ala, Pro or Val
PXXLXXXXXGXXXXXXXXLXXXXE

SEQ ID NO: 550 - protein, 14 aa, Artificial sequence
  Description of artificial sequence: amino acid sequence pattern comprised in a variant of SEQ ID NO: 322
  Variant (4)..(4): Xaa in position 4 is Ile or Met
  Variant (5)..(5): Xaa in position 5 is Ala or Leu
  Variant (6)..(7): Xaa in position 6 to 7 is any amino acid
  Variant (8)..(8): Xaa in position 8 is Ala or Leu
  Variant (10)..(12): Xaa in position 10 to 12 is any amino acid
  Variant (13)..(13): Xaa in position 13 is Pro or Val
RWAXXXXXGXXXXE

SEQ ID NO: 551 - protein, 42 aa, Artificial sequence
  Description of artificial sequence: amino acid sequence pattern comprised in a variant of SEQ ID NO: 322
  Variant (3)..(19): Xaa in position 3 to 19 is any amino acid
  Variant (20)..(23): Xaa in position 20 to 23 is any or no amino acid
  Variant (27)..(27): Xaa in position 27 is Phe, Leu or Val
  Variant (28)..(28): Xaa in position 28 is Ala, Gly or Ser
  Variant (29)..(29): Xaa in position 29 is any amino acid
  Variant (30)..(30): Xaa in position 30 is Phe or Leu
  Variant (31)..(31): Xaa in position 31 is Ala, Gly or Ile
  Variant (33)..(33): Xaa in position 33 is any amino acid
  Variant (34)..(34): Xaa in position 34 is Ala, Ile, Leu or Val
  Variant (36)..(38): Xaa in position 36 to 38 is any amino acid
  Variant (40)..(40): Xaa in position 40 is Gly or Gln
PLXXXXXXXXXXXXXXXXXXXXXLAMXXXXXFXXQXXXTXKG

SEQ ID NO: 552 - DNA, 873 bp, Arabidopsis thaliana
  CDS (1)..(873)
atggccgcaacatccgccgctgctgcagctgcttcttccatcatgggtactcgggtggctcccggtatccatcccggttcaggtcggttcacagccgtgttcggtttcggaaagaagaaggcagctcccaaaaagagtgccaaaaagacggtgactacggaccggcctctttggtacccaggcgccatttctcctgactggcttgatggttccttggttggagattacggttttgatcccttcggtttaggcaaaccggccgagtatcttcaattcgatatcgattcactagaccagaatctggctaagaacttggccggagacgtgatcggaacccgtacggaagctgccgacgccaaatcgacgccgtttcagccgtacagtgaggtgttcggaatccagagattcagggaatgcgaactcatccacggacggtgggcgatgctcgctactctcggcgctctctccgtcgaatggcttaccggcgttacatggcaagacgctggcaaggtggagcttgtagatggatcgtcctacttggggcagccattacctttctcgatctcgacattgatatggatcgaggtgttagtgatcggctacatcgagttccagcgcaacgccgagcttgattcggagaagcgtttataccccggaggcaagttctttgacccgctaggtttagcggctgacccggagaagactgctcaacttcagttagctgagatcaagcatgcacgtcttgcgatggtcgccttcttgggattcgcggttcaagcggctgcaacaggtaaaggtccactcaacaattgggctactcacctcagtgatccactccacaccaccatcatcgataccttctcctcatcttaa

SEQ ID NO: 553 - protein, 290 aa, Arabidopsis thaliana
MAATSAAAAAASSIMGTRVAPGIHPGSGRFTAVFGFGKKKAAPKKSAKKTVTTDRPLWYPGAISPDWLDGSLVGDYGFDPFGLGKPAEYLQFDIDSLDQNLAKNLAGDVIGTRTEAADAKSTPFQPYSEVFGIQRFRECELIHGRWAMLATLGALSVEWLTGVTWQDAGKVELVDGSSYLGQPLPFSISTLIWIEVLVIGYIEFQRNAELDSEKRLYPGGKFFDPLGLAADPEKTAQLQLAEIKHARLAMVAFLGFAVQAAATGKGPLNNWATHLSDPLHTTIIDTFSSS

SEQ ID NO: 554 - DNA, 1329 bp, Glycine max
  CDS (148)..(1020)
tttttttttattgattttacgtatttttttattttatattgtcttttgattgttatttattttttgtttattttttttatttttagttttttttttattgattttacgtatttttctcacaccaggcgcacgttagcacaaactatcatggccacggcaacagcagctgccacctcgtcctttatggggacgcgtctcctggaggctcactccggggcggggcgagtgcacgcccgattcggcttcggcaagaaaaaggctcccgccccaaagaaagcctccaggggatcgggccgagacaccgacagacccctttggtatccgggcgccaaagcgcccgaatatctcgatgggagtcttgtcggagactacgggttcgatccgtttgggctagggaagcccgcggagtacctgcagttcgagctggactcgctggaccagaaccttgcgaagaacgtggctggggacatcattggaaccaggaccgagctcgcggacgtgaagtccacgccgtttcagccctacagcgaggtgtttgggctccagaggttccgtgagtgcgaactcatccatggaaggtgggccatgctcgccactctcggagctctcactgttgagtggctcactggtgttacatggcaagacgccggacatgtggagctactagaagggtcatcataccttgggcaaccacttgcattctcaatcaccacactgatctggatcgaggtactcgcaattggctacatagagttccatatgaatgcacagctagacccacaaaaaaggctgtacccaggtggcagttacttcgaccccctgggcctggcctcagatccagagaagaaagccacccttcaattggcggagatcaagcacgcccgtctcgccatggtgggcttcttgggctttgcagtccaagctgccgccactggcaagggcccgctcaacaactgggccacccacttgagtgacccactccacacaaccatcattgacaccttctcatcctcctcttaagaagaagcaaaagaagaagaattgtctttcttgtgcctggtcattctagttatattgtaaaagtctttttcttcttcttcggctttgggttgtaattaaacattttctacatagctggattagtagtacttgtgaaaaacttgtaacgtgaaattggagaggctaagcaaaaatgcttttgcttgatgttaagtgttttcctgtgaatgttaattatgcccgaaatcgaaagggaaggccgccggtaaaaaaaactgatggggttaagatccctatgaaaggtaagggcaggaaattggattggggccc

SEQ ID NO: 555 - protein, 290 aa, Glycine max
MATATAAATSSFMGTRLLEAHSGAGRVHARFGFGKKKAPAPKKASRGSGRDTDRPLWYPGAKAPEYLDGSLVGDYGFDPFGLGKPAEYLQFELDSLDQNLAKNVAGDIIGTRTELADVKSTPFQPYSEVFGLQRFRECELIHGRWAMLATLGALTVEWLTGVTWQDAGHVELLEGSSYLGQPLAFSITTLIWIEVLAIGYIEFHMNAQLDPQKRLYPGGSYFDPLGLASDPEKKATLQLAEIKHARLAMVGFLGFAVQAAATGKGPLNNWATHLSDPLHTTIIDTFSSSS

SEQ ID NO: 556 - DNA, 1726 bp, Glycine max
  CDS (237)..(1118)
atgtaacaccagtgagccactcaccagtgagagctccgacagtggcgagcatggcccacctcccgtgaatgagctcgcactcgcggaacctttgcagcccgaacacctcgctgtagggctggaacggcgtggacttcacgtccgcgagctcggtcctggtcccaatgatgtccccaaccactaattctcccaactcaatttttctctcaaccggcccaatttagcataagcccagcatggccaccgcaacagcagcagccacctcgtccttcatggggacgcgcctcctggaggcccactccggggcggggcgggtgcaggcccggttcgggtttggcaagaagaaagccgccgccccgaagaaagtttccagggggtcgggctctagctccgataggcccctgtggtatccgggcgccaaggcgcccgagtacctggatgggagccttgtcggagactacggattcgacccatttgggctagggaagcccgccgagtacctgcagttcgagttggactcgctggaccagaaccttgcgaagaacgtggctggggacatcattgggaccaggaccgagctcgcggacgtgaagtccacgccgttccagccctacagcgaggtgttcgggctgcagaggttccgcgagtgcgagctcattcacgggaggtgggccatgctcgccactctcggagctctcactgttgagtggctcactggtgttacatggcaagacgccggaaaggtggagctagtggaaggttcatcatacctagggcaaccacttccattctcaatcaccacactgatctggatcgaggttctcgtaattggctacatagagttccagaggaacgcagagctggacccagaaaagaggctgtacccaggtggcagttacttcgacccactgggcctggcctcagatccagagaagaaagccacccttcaattggcggagatcaagcacgcccgtctcgccatggtgggcttcttgggctttgcagtccaagctgccgccactggcaagggcccgctcaacaactgggccacccacttgagtgacccactccacacaaccatcattgacaccttctcatcctcctcttactcctcttaagaagaagcaaaagaagaagaatagtctttcttgtgcctggtcattctagttatattgtaaaagtctttttcttcttcttcggctttgggttgtaattaaacattttctacatagctggattagtagtacttgtgaaaaacttgtaacgtgaaattggagaggctaagcagaaatgcttctgcttgatgttaagtgttctcctgtgaatgttaattatgcacgaaatcgagagggaaggacgacggtaaaaaatactgatgaggttaagatcactatgaaaggtaatggcaagaaattggattgaggccattggagattttaatttattcattttattaagtttgattctacataaacgctgatttgctgcagtacagaaaatagcgctggtttaccgaagttggtgaccaatggttaactaatggccaagttagactatatttcctacatctaattgctacattttgtttacattagttaagggcggtttgggttgattttgatcaaatttaagattgaactcaattaaatttgattaaaatttgattagtttaattcggtttttataaattcttttttgaaatttaattcaatcccacttattcatg

SEQ ID NO: 557 - protein, 293 aa, Glycine max
MATATAAATSSFMGTRLLEAHSGAGRVQARFGFGKKKAAAPKKVSRGSGSSSDRPLWYPGAKAPEYLDGSLVGDYGFDPFGLGKPAEYLQFELDSLDQNLAKNVAGDIIGTRTELADVKSTPFQPYSEVFGLQRFRECELIHGRWAMLATLGALTVEWLTGVTWQDAGKVELVEGSSYLGQPLPFSITTLIWIEVLVIGYIEFQRNAELDPEKRLYPGGSYFDPLGLASDPEKKATLQLAEIKHARLAMVGFLGFAVQAAATGKGPLNNWATHLSDPLHTTIIDTFSSSSYSS

SEQ ID NO: 558 - DNA, 1385 bp, Zea mays
  CDS (132)..(1007)
cgagttccacgcaacgccggctcattggcgtcgcggcattgggtacctcgaggccggccgggacgccacacaccaccaccggacgctagctcaccaccaacctcagcacatcgaggagaagaggagtggccatggcttcgtcggtggccgccgcggcgagcacattcctgggcacccgcctggcggacccggcgccgcagaacgggcgcatcgtggcccggttcgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaagcccgtggagtacctgcagttcgaactggactcgctggaccagaacctggccaagaacgaggccggcggcatcatcggcacccggttcgagtcctccgacgtcaagtccaccccgctccagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcggctcgccatggtcgccttcctcggcttcgccgtgcaggccgccgccaccggcaaggggccgctcaacaactgggccacccacctgagcgacccgctccacaccaccatcttcgacacgttcggagggtcctcttaagcccgccattgctccgccccgtccatcgaccggccggaacgtgttcttggattaattaactacgatctctatgagcctggggatggatcaacccgtcgtgcgtggtctcgttttgtgatgagtgggagagagaggatggcaagatcgatcctttgttaatggagatctcgttaattaggagagctaccgctgggacttggtggtttgtaatatatgatccaaccagtgatgaatcaatgcattcacttgtgtacacatataaaaaaaaaaaaaaggcaaaaaaaaaaaaaaaaaggcccctaccggtggacggcattgtgaagaaagagcacatcaagattcatggtttctgagcaaccgccgggtccataacaaacc

SEQ ID NO: 559 - protein, 291 aa, Zea mays
MASSVAAAASTFLGTRLADPAPQNGRIVARFGFGGGKPKAAVPKKVAKTSISSDRPLWFPGAVAPDYLDGSLVGDYGFDPFGLGKPVEYLQFELDSLDQNLAKNEAGGIIGTRFESSDVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGGSS

SEQ ID NO: 560 - DNA, 1157 bp, Glycine max
  CDS (74)..(934)
agcacagcaccaccacccgccacctcaacgcacgcaaaggccgaggaggacaagctaggaggagcgagcagccatggcttcgtcggtggccgccgcggcgagcgcgttcctcgggacccggctggcggacccggcgccgcagaacgggcgcatcgtggcgcggttcggcttcggcaagaagaaggccccgccgaagaaggccaaggcgcccccgaccaccgaccggccgctgtggttccccggcgcgcaggcgcccgagtacctcgacgggacgctcgtcggcgactacggcttcgaccccttcggccttgggaagcccgcggagtacctgcagtacgacgtggactccctggaccagaacctggcccagaacctggcgggcgagatcatcggcacccggttcgaggacgccgacgtcaagtccaccccgttccagccctacgccgaggtgttcggcctccagaggttccgcgagtgcgagctcatccacggtcgctgggccatgctcgccaccctcggcgccctcaccgtcgagtggctcaccggcgtcacctggcaggacgccggcaaggtggagctggtggacgggtcgtcgtacctggggcagccgctgccgttcacgctcaccacgctgatctggatcgaggtgctggtgatcgggtacatcgagttccagcgcaacgcggagctggacccggagaggaggctctaccccggtggctcctacttcgacccgctggggctcgcggcggacccggagaagaaggagactctgcagctggcggagatcaagcacgcccgcctcgccatggtcgccttcctcggcttcgccgtgcaggccgccgccaccggcaaggggcctctcaacaactgggccacccacctcagcgacccgctgcacaccaccatcttcgacaccttgggttcctcttaagtggtcggtggtcgagcaatttctgtcagctcagcagcaaaatggacgaacgcgcgtccgtgtaacgaacgtgctttggttttgtatgacgagtgatggatgagagggtatcgcacagatcctttgttgattaatgcaggtctgatcacataggagagctgctgggacttggtgatttgtaaaatatgaaccaatggtaacttaatgcatccacttgtacatc

SEQ ID NO: 561 - protein, 286 aa, Glycine max
MASSVAAAASAFLGTRLADPAPQNGRIVARFGFGKKKAPPKKAKAPPTTDRPLWFPGAQAPEYLDGTLVGDYGFDPFGLGKPAEYLQYDVDSLDQNLAQNLAGEIIGTRFEDADVKSTPFQPYAEVFGLQRFRECELIHGRWAMLATLGALTVEWLTGVTWQDAGKVELVDGSSYLGQPLPFTLTTLIWIEVLVIGYIEFQRNAELDPERRLYPGGSYFDPLGLAADPEKKETLQLAEIKHARLAMVAFLGFAVQAAATGKGPLNNWATHLSDPLHTTIFDTLGSS

SEQ ID NO: 562 - DNA, 1164 bp, Triticum aestivum
  CDS (85)..(945)
aaaacacaccacacaccacagcaccacccgccacctcaacgcacgcaaaggccgaggaggacaagctaggaggagcgagcagccatggcttcgtcggtggccgccgcggcgagcacgttcctcgggacccggctggcggacccggcgccgcagaacgggcgcatcgtggcgcggttcggcttcggcaagaagaaggccccgccgaagaaggccaaggcgcccccgaccaccgaccggccgctgtggttccccggcgcgcaggcgcccgagtacctcgacggcacgctcgtcggcgactacggcttcgaccccttcggcctcgggaagcccgcggagtacctgcagtacgacgtggactccctggaccagaacctggcccagaacctggcgggcgagatcatcggcacccggttcgaggacgccgacgtcaagtccaccccgttccagccctacgccgaggtgttcggcctccagaggttccgcgagtgcgagctcatccacggccgctgggccatgctcgccaccctcggcgccctcaccgtcgagtggctcaccggcgtcacctggcaggacgccggcaaggtggagctggtggacgggtcgtcgtacctggggcagccgctgccgttcacgctcaccacgttgatctggatcgaggtgctggtgatcgggtacatcgagttccagcgcaacgcggagctggacccggagaggaggctctaccccggtggctcctacttcgacccgctgggactcgcggcggacccggtgaagaaggagactctgcagctggcggagatcaagcacgcccgcctcgccatggtcgccttcctcggcttcgccgtgcaggccgccgccaccggcaaggggccactcaacaactgggccacccacctcagcgacccgctgcacaccaccatcttcgacaccttcggctcctcttaagtggtcggtggtcgagcaatttctgtcagctcagctgcaaaatggacgaacgcgcgtcagtgtacgaacgtgctttggttttgtatgacgagtgatggatgagagggtatcgcaaagatcctttgttgattaatgcaggtctgatcacataggagagctgctgggacttggtgatttgtaaaatatgaaccaatggtgacttaatgcatccacttgtac

SEQ ID NO: 563 - protein, 286 aa, Triticum aestivum
MASSVAAAASTFLGTRLADPAPQNGRIVARFGFGKKKAPPKKAKAPPTTDRPLWFPGAQAPEYLDGTLVGDYGFDPFGLGKPAEYLQYDVDSLDQNLAQNLAGEIIGTRFEDADVKSTPFQPYAEVFGLQRFRECELIHGRWAMLATLGALTVEWLTGVTWQDAGKVELVDGSSYLGQPLPFTLTTLIWIEVLVIGYIEFQRNAELDPERRLYPGGSYFDPLGLAADPVKKETLQLAEIKHARLAMVAFLGFAVQAAATGKGPLNNWATHLSDPLHTTIFDTFGSS

SEQ ID NO: 564 - DNA, 849 bp, Zea mays
  CDS (1)..(849)
  misc_feature (32)..(32): n is a, g, c or t
atggcacaccaaggagagtacgtggaggagcnagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcggctcgccatggtcgccttcctcggcttcgccgtgcaggccgccgccaccggcaaggggccgctcaacaactga

SEQ ID NO: 565 - protein, 282 aa, Zea mays
  misc_feature (11)..(11): The Xaa at location 11 stands for Arg, Gln, Leu, or Pro.
MAHQGEYVEEXAMASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNN

SEQ ID NO: 566 - DNA, 867 bp, Zea mays
  CDS (1)..(867)
  misc_feature (4)..(4): n is a, g, c or t
  misc_feature (5)..(5): n is a, g, c or t
  misc_feature (62)..(62): n is a, g, c or t
atgnnggtcgacttcgctgtcgacgatttcgtagcacaccaaggagagtacgtggaggagcnagccatggcttcatcggtggccgccgcggcgagcacattcctgggcacccgcctggcggacccggcgccacagaacgggcgcatcgtggcccggttcgggttcgggttgggcggcaaggcgaagcctgccccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcggctcgccatggtcgccttcctcggcttcgccgtgcaggccgccgccaccggcaaggggtga

SEQ ID NO: 567 - protein, 288 aa, Zea mays
  misc_feature (2)..(2): The Xaa at location 2 stands for Ala, Arg, Gln, Glu, Gly, Leu, Lys, Met, Pro, Ser, Thr, Trp, or Val.
  misc_feature (21)..(21): The Xaa at location 21 stands for Arg, Gln, Leu, or Pro.
MXVDFAVDDFVAHQGEYVEEXAMASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKG

SEQ ID NO: 568 - DNA, 885 bp, Zea mays
  CDS (1)..(885)
  misc_feature (30)..(30): n is a, g, c or t
atgtcgctgtcgacgatttcgtcttcatcngtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcgcctcgccatggtcgccttcctcggcttcgccgtgcaggccgccgccaccggcaaggggccgctcaacaactgggccacccacctgagcgacccgctccacactaccatcttcgacacgttcgggtga

SEQ ID NO: 569 - protein, 294 aa, Zea mays
MSLSTISSSSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFG

SEQ ID NO: 570 - DNA, 879 bp, Zea mays
  CDS (1)..(879)
atgggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcggctcgccatggtcgccttcctcggcttcgccgtgcaggccgccgccaccggcaaggggccgctcaacaactgggccacccacctgagcgacccgctccacaccaccatcttcgacacgttcggatga

SEQ ID NO: 571 - protein, 292 aa, Zea mays
MGAAMASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFG

SEQ ID NO: 572 - DNA, 903 bp, Zea mays
  CDS (1)..(903)
  misc_feature (32)..(32): n is a, g, c or t
atggcacaccaaggagagtacgtggaggagcnagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcgcctcgccatggtcgccttcctcggcttcgccgtgcaggccgccgccaccggcaaggggccgctcaacaactgggccacccacctgagcgacccgctccacactaccatcttcgacacgttcggatga

SEQ ID NO: 573 - protein, 300 aa, Zea mays
  misc_feature (11)..(11): The Xaa at location 11 stands for Arg, Gln, Leu, or Pro.
MAHQGEYVEEXAMASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFG

SEQ ID NO: 574 - DNA, 1037 bp, Zea mays
  CDS (48)..(914)
agaacaccccaactcacaaacgtgctaaacacaaacaaactctcgagatggccgccacttcaacagccgctgctgcttcttccatcatgggtactcgggtggtttccgacatcaactccggttcaagcaggttcacagcccggtttggattcgggaccaagaaggccgcagctcccaagaaggctaagacggttatctcagaccggcctctgtggttcccaggcgcgaaatctcccgagtatctcgacggttcgctggtcggagactacggttttgaccctttcggtttaggcaaaccggcggagtatctccagtttgatcttgactctctggaccagaacttagccaagaacatagccggagacgtgatcgggacccgtaccgaggccgctgaccccaagtcaacgccgtttcagccgtacagtgaggtctttgggctccagaggttcagagagtgtgagctgatccacgggagatgggctatgcttgcaactctcggtgctctctccgtcgagtggctcaccggtgttacttggcaagacgccggcaaggtagagctagtggatggatcgtcctatttaggacagccattaccgttctctatctcgacattgatttggatcgaagtgttggtgattggttacattgagttccaaagaaacgctgagttggactcagagaagcgtttgtatccaggaggcaagttcttcgacccgctcgggctagcttctgacccggagaagaaggctcagcttcagctggctgagatcaaacacgctcgtttagcgatggttgctttcttgggatttgcggttcaggcagctgcaacgggtaaaggaccgctcaacaactgggcgactcaccttagtgacccgcttcacaccaccatcatcgacaccttctcgtcctcttgatctggttgctttagcttttattggtgtgtaatgtaatgatgtccatcttgaaaacaaaagtttatgtaaacagagttcttgaaagtactctcaagtatcattggactaaaaaaaaaaaaaaaa

SEQ ID NO: 575 - protein, 288 aa, Zea mays
MAATSTAAAASSIMGTRVVSDINSGSSRFTARFGFGTKKAAAPKKAKTVISDRPLWFPGAKSPEYLDGSLVGDYGFDPFGLGKPAEYLQFDLDSLDQNLAKNIAGDVIGTRTEAADPKSTPFQPYSEVFGLQRFRECELIHGRWAMLATLGALSVEWLTGVTWQDAGKVELVDGSSYLGQPLPFSISTLIWIEVLVIGYIEFQRNAELDSEKRLYPGGKFFDPLGLASDPEKKAQLQLAEIKHARLAMVAFLGFAVQAAATGKGPLNNWATHLSDPLHTTIIDTFSSS

SEQ ID NO: 576 - DNA, 873 bp, Oryza sativa
  CDS (1)..(873): Japonica cultivar group
atggcgtcgtcggtggcagcggcggcgagcacgttcctggggacgaggctggcggacccggcgccgcagagcgggaggatcgtggcgaggttcgggttcggcggcgggaagaaggcggcggcgaagaaggcggcgaggccgtcggcgccgacgacggacaggccgctgtggttccccggcgcggtggcgccggactacctggacgggtcgctcgtcggcgactacggcttcgacccgttcggcctcgggaagccggcggagtacctgcagttcgagctggactcgctggaccagaacctggccaagaacaacgccggcgagatcatcggcacccggttcgagaccggcgaggtgaagtccaccccgttccagccctacaccgaggtgttcggcctccagcgcttccgcgagtgcgagctcatccacggccgctgggccatgctcgccaccctcggcgccctctccgtcgagtggctcaccggcgtcacctggcaagacgccggcaaggtggagctggtggatgggtcgtcgtacctggggcagccgctgccgttctcgatctcgacgctgatctggatcgaggtgctcgtcatcggctacatcgagttccagcgcaacgcggagctggacccggagaagaggctgtacccgggggggtcctacttcgacccgctcgggttggcgtcggacccggagaagaaggagcggctgcagctggcggagatcaagcacgcccgcctcgccatggtcgccttcctcggcttcgccgtgcaggccgccgccaccggcaaggggcccctcaacaactgggccacccacctcagcgacccgctccacaccaccatcttcgacaccttctcctcatcctcttaa

SEQ ID NO: 577 - protein, 290 aa, Oryza sativa
  Japonica cultivar group
MASSVAAAASTFLGTRLADPAPQSGRIVARFGFGGGKKAAAKKAARPSAPTTDRPLWFPGAVAPDYLDGSLVGDYGFDPFGLGKPAEYLQFELDSLDQNLAKNNAGEIIGTRFETGEVKSTPFQPYTEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLASDPEKKERLQLAEIKHARLAMVAFLGFAVQAAATGKGPLNNWATHLSDPLHTTIFDTFSSSS

SEQ ID NO: 578 - DNA, 876 bp, Zea mays
  CDS (1)..(876)
atggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcgcctcgccatggtcgccttcctcggcttcgccgtgcaggccgccgccaccggcaaggggccgctcaacaactgggccacccacctgagcgacccgctccacactaccatcttcgacacgttcggagggtcctcttaa

SEQ ID NO: 579 - protein, 291 aa, Zea mays
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGGSS

SEQ ID NO: 580 - DNA, 864 bp, Arabidopsis thaliana
  CDS (1)..(864)
atggccgccacttcaaccgccgctgctgcttcttcaatcatgggtacccgggtggtttccgacattagctccaattcaagccggttcacagcccggttcggattcggaaccaagaaagcatctcccaaaaaggctaagacggttatctcagaccggcctctatggttcccaggcgcaaaatcacccgaatatctcgacggttcacttgtcggggactacgggttcgatccttttggtttaggcaaaccggcggagtatctccaattcgatttggattccttggaccagaacttagccaagaacttatacggagaagtgatcgggactcgtaccgaggcggtggaccccaaatcgacgccgtttcagccatatagtgaagtcttcgggctacaaagattcagagaatgtgagctgattcacggtcggtgggcaatgctcgccactcttggcgctatcaccgtcgaatggctcaccggtgttacttggcaagacgccggcaaggtagagctagtggatggatcatcttacttaggacagccattgccgttctctatctcgacattgatatggatcgaagtgttagtgatcggctacattgagttccaacgaaacgctgaactggactcggagaagcgtttgtatccaggaggcaagttctttgacccgttaggactagcgtctgacccggtgaagaaggctcagcttcagctagctgagatcaaacatgctcgtttagccatggttggattcttgggttttgcggttcaggcggctgcaaccggtaaaggaccgctcaacaactgggcgactcaccttagtgacccacttcacaccaccattatcgataccttctcttcctcctga

SEQ ID NO: 581 - protein, 287 aa, Arabidopsis thaliana
MAATSTAAAASSIMGTRVVSDISSNSSRFTARFGFGTKKASPKKAKTVISDRPLWFPGAKSPEYLDGSLVGDYGFDPFGLGKPAEYLQFDLDSLDQNLAKNLYGEVIGTRTEAVDPKSTPFQPYSEVFGLQRFRECELIHGRWAMLATLGAITVEWLTGVTWQDAGKVELVDGSSYLGQPLPFSISTLIWIEVLVIGYIEFQRNAELDSEKRLYPGGKFFDPLGLASDPVKKAQLQLAEIKHARLAMVGFLGFAVQAAATGKGPLNNWATHLSDPLHTTIIDTFSSS

SEQ ID NO: 582 - DNA, 831 bp, Arabidopsis thaliana
  CDS (1)..(831)
atggctaccaccactgcagcagcagcctcaggtatttttgggatccggattcaagatcctagacctggaaccggtagggtccaagcccggttcgggttcagtttcggaaaaaagaaaccggctccaccgccaaagaaatcaaggcaggtccaagacgatggagacagactagtttggttccccggcgcaaacccgccggaatggttggacggatcgatgatcggagaccgtggatttgatccgtttggtttaggtaaaccggctgagtatcttcagtacgatttcgatggacttgaccaaaaccttgccaagaacgtggcgggtgacatcatcgggatcatccaagaatcttcggagatcaaaccgacgccgtttcagccgtacactgaagtctttgggatccaacggttcagagaatgtgagctgatccatggaaggtgggccatgcttggcactctaggcgccatcgccgtagaggctcttacaggaattgcatggcaagacgccggaaaggtggaattggtggaaggatcatcgtatttgggacaaccattgccgttctcgttgacgacgttgatatggatagaagtgttagtggtcggatacattgagttccaacgtaactctgaactggatccagagaaacggatttacccgggtgggtattttgacccgttgggactcgcggctgatccagagaagttggatactttgaagctggctgagataaagcactctcgtctcgctatggtcgcatttctcatctttgctcttcaggcggcctttaccggcaaaggccctgtcagcttccttgccacctttaacaattag

SEQ ID NO: 583 - protein, 276 aa, Arabidopsis thaliana
MATTTAAAASGIFGIRIQDPRPGTGRVQARFGFSFGKKKPAPPPKKSRQVQDDGDRLVWFPGANPPEWLDGSMIGDRGFDPFGLGKPAEYLQYDFDGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIEFQRNSELDPEKRIYPGGYFDPLGLAADPEKLDTLKLAEIKHSRLAMVAFLIFALQAAFTGKGPVSFLATFNN

SEQ ID NO: 584 - DNA, 1178 bp, Zea mays
  CDS (38)..(913)
caccaacctcagcacatcgaggagaggaggagtggccatggcttcgtcggtggccgccgcggcgagcacattcctgggcacccgcctggcggacccggcgccgcagaacgggcgcatcgtggcccggtttgggttcggcggcggaaagcccaaggctgccgtcccgaagaaggtggcgaagacgtcgatctcctctgaccggccgctgtggttccccggcgccgtggcgcccgactacctcgacggctcgctggtcggcgactacgggttcgacccgttcgggctcgggaagcccgtggagtacctgcagttcgaactggactcgctggaccagaacctggccaagaacgaggccggcggcatcatcggcacccggttcgagtcctccgacgtcaagtccaccccgctccagccctacagcgaggtgttcggcctccagcggttccgcgagtgcgagctcatccacggccgatgggccatgctcgccaccctcggcgccctcaccgtcgagtggctcaccggcgtcacctggcaggatgctggcaaggtggagctggtggatgggtcctcctacctgggccagccgctgccgttcaccatctcgacgctcatctggatcgaggtgcttgtgatcggctacatcgagttccagcgcaacgccgagctcgacccggagaagaggctgtaccccggcggctcctactttgacccgctcgccttggcggccgaccccgagaagaaggagcggctgcagctggcggagatcaagcacgcgcgcctcgccatggtcgccttcctcggcttcgccgtgcaggccgccgccaccggcaaggggccactcaacaactgggccacccaccttagcgacccactccataccaccatcttcgacacgttcggaggatcctcttaagcccgccattgatccgctccgtccatcgatcgaaacgtggtcttgaattaactatgatagatctctatgagcctggagatggatcaacccgtcgtgcgttgtttcattttgtgatgaatgggagagagggtatgggacaagattgatcaacccgtcgtgcttacgtctcgttaattaggagagctaccgctcggatttggtgatttgtaatatatgaaccagtgatgaataaatgcattcacttgtacaaaaaaaaaaaaaaaaa

SEQ ID NO: 585 - protein, 291 aa, Zea mays
MASSVAAAASTFLGTRLADPAPQNGRIVARFGFGGGKPKAAVPKKVAKTSISSDRPLWFPGAVAPDYLDGSLVGDYGFDPFGLGKPVEYLQFELDSLDQNLAKNEAGGIIGTRFESSDVKSTPLQPYSEVFGLQRFRECELIHGRWAMLATLGALTVEWLTGVTWQDAGKVELVDGSSYLGQPLPFTISTLIWIEVLVIGYIEFQRNAELDPEKRLYPGGSYFDPLALAADPEKKERLQLAEIKHARLAMVAFLGFAVQAAATGKGPLNNWATHLSDPLHTTIFDTFGGSS

SEQ ID NO: 586 - protein, 287 aa, Artificial sequence
  Description of artificial sequence: consensus sequence
  Variant (2)..(2): Xaa in position 2 is any amino acid
  Variant (3)..(3): Xaa in position 3 is any or no amino acid
  Variant (9)..(11): Xaa in position 9 to 11 is any amino acid
  Variant (15)..(16): Xaa in position 15 to 16 is any amino acid
  Variant (17)..(17): Xaa in position 17 is any or no amino acid
  Variant (19)..(23): Xaa in position 19 to 23 is any amino acid
  Variant (26)..(27): Xaa in position 26 to 27 is any amino acid
  Variant (34)..(37): Xaa in position 34 to 37 is any amino acid
  Variant (38)..(41): Xaa in position 38 to 41 is any or no amino acid
  Variant (45)..(50): Xaa in position 45 to 50 is any amino acid
  Variant (51)..(53): Xaa in position 51 to 53 is any or no amino acid
  Variant (63)..(64): Xaa in position 63 to 64 is any amino acid
  Variant (66)..(66): Xaa in position 66 is any amino acid
  Variant (87)..(87): Xaa in position 87 is any amino acid
  Variant (93)..(94): Xaa in position 93 to 94 is any amino acid
  Variant (105)..(105): Xaa in position 105 is any amino acid
  Variant (108)..(108): Xaa in position 108 is any amino acid
  Variant (114)..(114): Xaa in position 114 is any amino acid
  Variant (116)..(119): Xaa in position 116 to 119 is any amino acid
  Variant (124)..(124): Xaa in position 124 is any amino acid
  Variant (128)..(128): Xaa in position 128 is any amino acid
  Variant (156)..(156): Xaa in position 156 is any amino acid
  Variant (189)..(189): Xaa in position 189 is any amino acid
  Variant (221)..(221): Xaa in position 221 is any amino acid
  Variant (230)..(230): Xaa in position 230 is any amino acid
  Variant (236)..(237): Xaa in position 236 to 237 is any amino acid
  Variant (284)..(284): Xaa in position 284 is any amino acid
SXXAAAASXXXGTRXXXDXXXXXGRXXARFGFGXXXXXXXXPKKXXXXXXXXXDRPLWFPGAXXPXYLDGSLVGDYGFDPFGLGKPXEYLQFXXDSLDQNLAKNXAGXIIGTRXEXXXXKSTPXQPYXEVFGLQRFRECELIHGRWAMLATLGALXVEWLTGVTWQDAGKVELVDGSSYLGQPLPFSIXTLIWIEVLVIGYIEFQRNAELDPEKRLYPGGXYFDPLGLAXDPEKKXXLQLAEIKHARLAMVAFLGFAVQAAATGKGPLNNWATHLSDPLHTTIXDTF

SEQ ID NO: 587 - protein, 40 aa, Artificial sequence
  Description of artificial sequence: amino acid sequence pattern comprised in a variant of SEQ ID NO: 553
  Variant (5)..(5): Xaa in position 5 is Ser or Thr
  Variant (6)..(6): Xaa in position 6 is Ile or Leu
  Variant (7)..(7): Xaa in position 7 is Ser or Thr
  Variant (30)..(30): Xaa in position 30 is Pro or Ser
  Variant (32)..(32): Xaa in position 32 is Lys or Arg
  Variant (39)..(39): Xaa in position 39 is any amino acid
  Variant (40)..(40): Xaa in position 40 is Phe or Tyr
PLPFXXXTLIWIEVLVIGYIEFQRNAELDXEXRLYPGGXX

SEQ ID NO: 588 - protein, 40 aa, Artificial sequence
  Description of artificial sequence: amino acid sequence pattern comprised in a variant of SEQ ID NO: 553
  Variant (5)..(5): Xaa in position 5 is Ala or Ser
  Variant (10)..(10): Xaa in position 10 is any amino acid
  Variant (11)..(11): Xaa in position 11 is Ala, Asp or Glu
  Variant (12)..(12): Xaa in position 12 is any amino acid
  Variant (14)..(14): Xaa in position 14 is any amino acid
  Variant (21)..(21): Xaa in position 21 is Ala or Ser
  Variant (27)..(27): Xaa in position 27 is Ala or Gly
  Variant (30)..(30): Xaa in position 30 is Gly or Ile
  Variant (33)..(33): Xaa in position 33 is Leu or Val
  Variant (37)..(37): Xaa in position 37 is any amino acid
LGLAXDPEKXXXLXLAEIKHXRLAMVXFLXFAXQAAXTGK

SEQ ID NO: 589 - protein, 15 aa, Artificial sequence
  Description of artificial sequence: amino acid sequence pattern comprised in a variant of SEQ ID NO: 553
NNWATHLSDPLHTTI

SEQ ID NO: 590 - protein, 17 aa, Artificial sequence
  Description of artificial sequence: amino acid sequence pattern comprised in a variant of SEQ ID NO: 553
  Variant (2)..(2): Xaa in position 2 is Ala or Thr
  Variant (5)..(6): Xaa in position 5 to 6 is any or no amino acid
  Variant (8)..(8): Xaa in position 8 is Ala, Ser or Thr
  Variant (9)..(9): Xaa in position 9 is Phe or Ile
  Variant (10)..(10): Xaa in position 10 is Leu or Met
  Variant (14)..(14): Xaa in position 14 is Leu or Val
  Variant (15)..(15): Xaa in position 15 is Ala, Leu or Val
  Variant (16)..(16): Xaa in position 16 is Asp, Glu, Pro or Ser
  Variant (17)..(17): Xaa in position 17 is Ala, Asp, Gly or Pro
AXAAXXSXXXGTRXXXX

SEQ ID NO: 591 - DNA, 756 bp, Arabidopsis thaliana
  CDS (1)..(756)
atggctactgtcactactcatgcctcggcctcgattttccgaccttgtacttcaaagccaagattcctcaccggttcttccggtaggttgaaccgcgacttgtcgtttacatcgatcggttcatcggccaaaacgtcgtcgttcaaggttgaagctaagaaaggagaatggttgcccggtttggcatcgcctgattatctcaccggcagtcttgccggtgacaatgggtttgacccgttgggtctagcagaggatccagagaacttgaaatggttcgtccaggcagagctggtcaacggacgatgggctatgctcggtgtcgctgggatgcttttgccggaagttttcaccaagatcggaatcataaatgttcctgagtggtacgatgctgggaaagagcagtattttgcatcgtcgtcgacattgttcgtgatcgagttcatattgtttcattacgttgagatcagacggtggcaagacatcaagaacccaggaagtgtgaaccaagaccctatctttaagcaatacagcttacctaagggtgaagttggttaccctggtggaatctttaacccgcttaactttgctcctacgcaagaggccaaggagaaagagctagcaaacgggaggttggcgatgttggcattcttagggtttgtggttcaacacaatgtgactggaaaaggaccatttgagaatctgttgcagcacttgtctgacccatggcacaacactattgtccaaaccttcaactaa

SEQ ID NO: 592 - protein, 251 aa, Arabidopsis thaliana
MATVTTHASASIFRPCTSKPRFLTGSSGRLNRDLSFTSIGSSAKTSSFKVEAKKGEWLPGLASPDYLTGSLAGDNGFDPLGLAEDPENLKWFVQAELVNGRWAMLGVAGMLLPEVFTKIGIINVPEWYDAGKEQYFASSSTLFVIEFILFHYVEIRRWQDIKNPGSVNQDPIFKQYSLPKGEVGYPGGIFNPLNFAPTQEAKEKELANGRLAMLAFLGFVVQHNVTGKGPFENLLQHLSDPWHNTIVQTFN

SEQ ID NO: 593 - DNA, 1126 bp, Glycine max
  CDS (86)..(844)
tacggctgcgagaagacgacagaaggggaccacactcttattgttttcttcatatcttccttgtcactgcccgtgtgtcgccgccatggccaccgtcaccacccaagcctccgccgcaattttccggccatgtacctcgaaatcgaggtttttgaccggctcttccggtaaacttaaccgggaagtgactatgcggccaatggggtgcccttctcctgcctctttcaaggttgaagccaagaagggagagtggttacctggcttggcctccccaacttacctcaatggcactcttcctggtgacaatggatttgaccctctggggctagctgaggacccagagaacttgaggtggtacgttcaagccgagcttgtgaatggacgttgggccatgttgggtgttgcaggaatgttgcttcctgaggttttcaccaagtttggaatcatcaatgcccctcaatggtatgatgctgggaaatcggagtactttgcatcttcctcaaccctcttcgtgatcgagttcatcttgttccactacgtcgagatccggagatggcaggacatcaagaaccctggctgtgtcaaccaagaccccatcttcaagcaatacagcttgcccccacatgagtgtggataccctggtagtgtgttcaaccccttgaactttgcacctactttggaggccaaggagaaggaacttgccaatgggagattggctatgttggcattcttgggattcatagttcaacacaacgtgacaggcaaaggaccatttgagaacctcttgcagcacctctctgacccgtggcacaacaccatcatcaatacaattcgtggctactaagtttgtatccaatgacatggataagcctgtgtccttctcgtgtaatcctgaatggatgaattttgagagtgatttgggcgtgattgttgtgatccatctattttcatgtacagaggaactacgatggttttatattgttatttagactgtccatcaatcagtaatcaagcatgatactttctaaaaatttcatcaaaattctaatacaatatatccaaagtatatatgtaaaatttgcttccattttcttacaaatttcaaatttacaacttggatcaccaa

SEQ ID NO: 594 - protein, 252 aa, Glycine max
MATVTTQASAAIFRPCTSKSRFLTGSSGKLNREVTMRPMGCPSPASFKVEAKKGEWLPGLASPTYLNGTLPGDNGFDPLGLAEDPENLRWYVQAELVNGRWAMLGVAGMLLPEVFTKFGIINAPQWYDAGKSEYFASSSTLFVIEFILFHYVEIRRWQDIKNPGCVNQDPIFKQYSLPPHECGYPGSVFNPLNFAPTLEAKEKELANGRLAMLAFLGFIVQHNVTGKGPFENLLQHLSDPWHNTIINTIRGY

SEQ ID NO: 595 - DNA, 1178 bp, Zea mays
  CDS (102)..(845): subsp. mays
agtttaatacaaaccaggcttgctcgtggcggcaaaaaaccaacgtgcttgatctccctccgccactccatccatctcctcgctcccagtccccgggaagcatggcgtccgtcaccgcccgcgccccggtagcggcccttcgcccgtcgtcggcatcgctcaagtcgtcgtcggccttccttggccactctagccgcctcggccgcaccgcgtctcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgccgcagtggtacgacgccagcaagtcggagtacttcgcgtcgtcgtccacgctgttcgtggtcgagttcatcctgttccactacgtggagatccggcggtggcaggacatcaagaaccccggcagcgtcaaccaggaccccatcttcaagagctacagcctgccgccgcacgagtgcggctacccgggcagcgtcttcaacccgctcaacttcgcgcccacgctcgaggccaaggagaaggagctcgccaacgggaggctggcgatgctggcgttcctgggcttcctgatccagcacaacgtcaccggcaaggggcccttcgacaacctgctgcagcacctgtctgacccatggcacaacaccatcatccagaccttctccggttgagtcgaggtcgaggagggatacgatccatcgctggtgagctgatatggactggaaggcaaacattgaaaccttaagttcctttctggatcagtttgtgtgtgttgttaatctatctggagggtacagattcgggccgtgttgcaatgcatgcatggtctgaagggagcgagggctgaggagtgactggtatgtacattagctgaaggggatattaagggtagagatcgtttgatcagtatcatctgtatatccccatgcatggggtttcgttttgtgcgcttacttctggcttgccagcgtatggttcaatgtggaaacacatgtattagtacg

SEQ ID NO: 596 - protein, 247 aa, Zea mays
  subsp. mays
MASVTARAPVAALRPSSASLKSSSAFLGHSSRLGRTASPTRRSLKAEAKGEWLPGLPSPSYLDGSLAGDNGFDPLGLAEDPENLRWFVQAELVNGRWAMLGVAGMLIPEVLTKAGLINAPQWYDASKSEYFASSSTLFVVEFILFHYVEIRRWQDIKNPGSVNQDPIFKSYSLPPHECGYPGSVFNPLNFAPTLEAKEKELANGRLAMLAFLGFLIQHNVTGKGPFDNLLQHLSDPWHNTIIQTFSG

SEQ ID NO: 597 - DNA, 1116 bp, Zea mays
  CDS (104)..(847): subsp. mays
aatacaaaccaggcttgctcgtggcggcaaaaaccaacgtgctcgatctccctccgccactccatccatctcctcgctcccagtccccgggaagctacgaagcatggcgtccgtcaccgcccgcgccccggtcgcggcccttcgcccgtcgtcggcatcgctcaagtcgtcgtcggccttccttggccactctagccgcctcggccgcaccgcgtcgcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgccgcagtggtacgacgccggcaagtcggagtacttcgcgtcgtcgtccacgctgttcgtggtcgagttcatcctgttccactacgtggagatccggcggtggcaggacatcaagaaccccggcagcgtcaaccaggaccccatcttcaagagctacagcctgccgccgcacgagtgcggctacccgggcagcgtcttcaacccgctcaacttcgcgcccacgctcgaggccaaggagaaggagctcgccaacgggaggctggcgatgctggcgttcctgggcttcctgatccagcacaacgtcaccggcaaggggcccttcgacaacctgctgcagcacctgtctgacccatggcacaacaccatcatccagaccttctccggttgagtcgaggtcgaggagggatacgatccatcgctggtgagctgatatggactggaaggcaaacattgaaaccttaaattcctttctggatcagtttgtgtgtgttaatctatctggagggtacagattcgggccgtgttgcaatgcatgcatggtctgaagggagcgagggctgaggagtgactggtatgtacattagctgaaggggaggttaagggtagagatcgtttgatcagtatcatctgtatatccccatgcatggggtttcgttt

SEQ ID NO: 598 - protein, 247 aa, Zea mays
  subsp. mays
MASVTARAPVAALRPSSASLKSSSAFLGHSSRLGRTASPTRRSLKAEAKGEWLPGLPSPSYLDGSLAGDNGFDPLGLAEDPENLRWFVQAELVNGRWAMLGVAGMLIPEVLTKAGLINAPQWYDAGKSEYFASSSTLFVVEFILFHYVEIRRWQDIKNPGSVNQDPIFKSYSLPPHECGYPGSVFNPLNFAPTLEAKEKELANGRLAMLAFLGFLIQHNVTGKGPFDNLLQHLSDPWHNTIIQTFSG

SEQ ID NO: 599 - DNA, 1135 bp, Zea mays
  CDS (67)..(801): subsp. mays
aaaggaccaacgtgctcgatctccatctcgaccgtcgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgacgaggcgcagcctcaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtcgtcgacgctgttcgtgatcgagttcatcctgtttcactacgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggaggctggccatgctggcgttcctggccttcctgatccagcacaacgtcaccggcaaggggcccttcgacaacctgctgcagcacctgtccgacccatggcacaacaccatcatccagaccctgtcgggttgagtcgacggtccatcaggtcatgtgatccgagctgaaataaaggaagacaaatcttgaaacgcgatcgatgttacgttcctttctgggccggatcagttcgtgtgatgcgttcttaatcgactgagggctaaggaatgtgacgtactggtatatgtacattagttgaagcggaggctataaagggtgtagagattgtttcatcagtgtatatcatctgtcccgatgggttttgttttgtgcttttcacgattcattgtggaagcacatgtattattagtacaagaactgctagtagatatataggcttataattaagcacgacttctaaaacctc

SEQ ID NO: 600 - protein, 244 aa, Zea mays
  subsp. mays
MASVTARAPVAALRPSSSSAFLGHSSRLGRTATASPTRRSLKAEAKGEWLPGLPSPAYLDGSLPGDNGFDPLGLAEDPENLRWYVQAELVNGRWAMLGVAGMLIPEVLTKAGLINAPQWYDAGKSEYFASSSTLFVIEFILFHYVEIRRWQDIKNPGSVNQDPIFKSYSLPPHECGYPGSVFNPLNFAPTLEAKEKELANGRLAMLAFLAFLIQHNVTGKGPFDNLLQHLSDPWHNTIIQTLSG

SEQ ID NO: 601 - DNA, 1024 bp, Glycine max
  CDS (76)..(834)
gtacaaaacaaaaaccacctcactcttattgttttcttaaaatttcttccttgccactgccagtgtgtcaccaccatggccaccgtcacaacccaagcctccgccgcgattttccggccatgtgcctcgaaatcgaggtttctgaccgtctcttccggtaaactcaaccgggaagtgactatgaggccaatggggtgccctccttctgcctctttcaaggttgaagccaagaagggagagtggttacctggcttggcctccccaacttacctcaatggcactcttcctggtgacaatggatttgaccctctgggactagctgaggacccagagaacttgaggtggtacgttcaagccgagcttgtgaatggacgttgggccatgttgggtgttgcaggaatgctacttcctgaggttttcaccaagattggaatcatcaatgcccctcaatggtatgatgctgggaaatcggagtactttgcttcatcgtcgaccctctttgtgatcgagttcatcttgttccactacgtcgagatccggagatggcaggacatcaagaaccctggctctgtcaaccaagaccccatcttcaagcaatacagcttgccccaacatgagtgtggataccctggtagtgtgtttaaccccttgaactttgcacctactttggaggccaaggagaaggaacttgccaatgggagattggctatgttggcattcttgggattcatagttcaacacaacgtgacaggcaaaggaccatttgagaacctattgcagcacctctctgacccgtggcacaacaccatcatcaatacaattcgtggctactaagtttgtatccaatgacatggataagcctgtgtccttctcgtgtaatcctgaatggatgaattttgagagtgatttgggcatgattgttatgatccgtctattttcatgtacagaggaactacgatggttttacattgttatttagactgtccatcaatcagtaatcaagcatgatactttctaaaaattt

SEQ ID NO: 602 - protein, 252 aa, Glycine max
MATVTTQASAAIFRPCASKSRFLTVSSGKLNREVTMRPMGCPPSASFKVEAKKGEWLPGLASPTYLNGTLPGDNGFDPLGLAEDPENLRWYVQAELVNGRWAMLGVAGMLLPEVFTKIGIINAPQWYDAGKSEYFASSSTLFVIEFILFHYVEIRRWQDIKNPGSVNQDPIFKQYSLPQHECGYPGSVFNPLNFAPTLEAKEKELANGRLAMLAFLGFIVQHNVTGKGPFENLLQHLSDPWHNTIINTIRGY

SEQ ID NO: 603 - DNA, 983 bp, Glycine max
  CDS (63)..(821)
  misc_feature (707)..(707): n is a, g, c or t
  misc_feature (727)..(727): n is a, g, c or t
  misc_feature (775)..(775): n is a, g, c or t
  misc_feature (792)..(792): n is a, g, c or t
  misc_feature (858)..(858): n is a, g, c or t
aaaccaccacactcttattgttttcttcatatcttccttgtcactgcccgtgtgtcgccgccatggccaccgtcaccacccaagcctccgccgcaattttccggccatgtacctcgaaatcgaggtttttgaccggctcttccggtaaacttaaccgggaagtgactatgcggccaatggggtgccctccttctgcctctttcaaggttgaagccaagaagggagagtggttacctggcttggcctccccaacttacctcaatggcactcttcctggtgacaatggatttgaccctctggggctagctgaggacccagagaacttgaggtggtacgttcaagccgagcttgtgaatggacgttgggccatgttgggtgttgcaggaatgttgcttcctgaggttttcaccaagtttggaatcatcaatgcccctcaatggtatgatgctgggaaatcagagtactttgcatcttcctcaaccctcttcgtgatcgagttcatcttgttccactacgtcgagatccgaagatggcaggacatcaagaaccctggctgtgtcaaccaagaccccatcttcaagcaatacagcttgcccccacatgagtgtggataccctggtagtgtgttcaaccccttgaactttgcacctactttggaggccaaggagaaggaacttgccaatgggagattggctatgttggcattnttgggattcatagttcaacncaacgtgacaggcaaaggaccatttgagaacctcttgcagcacctctntgacccgtggcacaacnccatcatcaatacaattcgtggctactaagtttgtatccaatgacatggataagcctgtgtccttntcgtgtaatcctgaatggatgaattttgagagtgatttgggcgtgattgttgtgatccatctattttcatgtacagaggaactacgatggttttatattgttatttagactgtccatcaatcagt

SEQ ID NO: 604 - protein, 252 aa, Glycine max
  misc_feature (215)..(215): The Xaa at location 215 stands for Leu, or Phe.
  misc_feature (222)..(222): The Xaa at location 222 stands for Arg, His, Leu, or Pro.
  misc_feature (238)..(238): The Xaa at location 238 stands for Cys, Phe, Ser, or Tyr.
  misc_feature (244)..(244): The Xaa at location 244 stands for Ala, Pro, Ser, or Thr.
MATVTTQASAAIFRPCTSKSRFLTGSSGKLNREVTMRPMGCPPSASFKVEAKKGEWLPGLASPTYLNGTLPGDNGFDPLGLAEDPENLRWYVQAELVNGRWAMLGVAGMLLPEVFTKFGIINAPQWYDAGKSEYFASSSTLFVIEFILFHYVEIRRWQDIKNPGCVNQDPIFKQYSLPPHECGYPGSVFNPLNFAPTLEAKEKELANGRLAMLAXLGFIVQXNVTGKGPFENLLQHLXDPWHNXIINTIRGY

SEQ ID NO: 605 - DNA, 735 bp, Oryza sativa
  CDS (1)..(735): Japonica cultivar group
atggcgtccgtcaccgcccgcaccccggtcgcagccctccgctcgtcggcgtcgctcaagtctaccttcctagggcaatcctccacccgcctcgcccgcgcaccgactacgaggcgtaatgttcgggcggaggccaagggagagtggctccccggcctcccttctcccacctacctcaacggcagcttgccaggcgataacgggttcgacccgttgggtctggcggaggacccggagaacctgcggtggttcgtgcaggcggagctggtgaacgggcggtgggcgatgctgggggtggccgggatgctgctgcctgaggtgctgacgaagatcgggttgatcgacgcgccgcagtggtacgacgccggcaaggccacctacttcgcgtcgtcgtcgacgctgttcgtcatcgagttcatcctgttccactacgtggagatccggcggtggcaggacatcaagaaccctggctgcgtcaaccaggaccccatcttcaagagctacagcctcccgccgcacgagtgcggctaccccggcagcgtcttcaaccccctcaacttcgagcccaccctcgaggccaaggagaaggagctcgccaacgggaggctggcgatgctggcgttcttggggttcctggtgcagcacaacgtgacgcagaaggggcccttcgacaacctgctgcagcacctgtctgacccgtggcacaacaccatcatccagacgctgtcaggctga

SEQ ID NO: 606 - protein, 244 aa, Oryza sativa
  Japonica cultivar group
MASVTARTPVAALRSSASLKSTFLGQSSTRLARAPTTRRNVRAEAKGEWLPGLPSPTYLNGSLPGDNGFDPLGLAEDPENLRWFVQAELVNGRWAMLGVAGMLLPEVLTKIGLIDAPQWYDAGKATYFASSSTLFVIEFILFHYVEIRRWQDIKNPGCVNQDPIFKSYSLPPHECGYPGSVFNPLNFEPTLEAKEKELANGRLAMLAFLGFLVQHNVTQKGPFDNLLQHLSDPWHNTIIQTLSG

SEQ ID NO: 607 - DNA, 756 bp, Solanum tuberosum
  CDS (1)..(756)
atggcaaccgtgacaacacaagcttccgccgccattttccggccatgtgcctcaagaaccaggttcctcactggatcatctggaaagttaaacagggaggtctcttttagaccttcaacttcttcatcatacaactcattcaaggttgaagctaagaaaggtcaatggcttcctggcttagcctctcctgattatcttgatggcagtctcccaggagacaatggttttgatccattgggactggctgaggacccagagaacttgaaatggttcatccaggctgaactagtgaatggtcgttgggctatgttgggtgttgcagggatgctgttgcctgaggttttcactagcattgggatacttaacgtgcccaaatggtacgatgctggaaaatccgagtactttgcatcatcatcgaccctgtttgtgatcgagttcatcttgttccactacgtcgagatcagaaggtggcaagacattaagaacccaggaagtgtcaaccaagaccctatcttcaagagctacagcttgcctcctaataaatgtggataccctggtggtattttcaacccactcaactttgcaccaactgaagaggccaaggagaaggaacttgctaatgggagattggctatgttagcatttttgggattcatagttcagcacaatgtgactggaaagggaccttttgacaaccttttgcagcacctttttgacccatggcacaacaccatcatccaaacactcagcaactag

SEQ ID NO: 608 - protein, 251 aa, Solanum tuberosum
MATVTTQASAAIFRPCASRTRFLTGSSGKLNREVSFRPSTSSSYNSFKVEAKKGQWLPGLASPDYLDGSLPGDNGFDPLGLAEDPENLKWFIQAELVNGRWAMLGVAGMLLPEVFTSIGILNVPKWYDAGKSEYFASSSTLFVIEFILFHYVEIRRWQDIKNPGSVNQDPIFKSYSLPPNKCGYPGGIFNPLNFAPTEEAKEKELANGRLAMLAFLGFIVQHNVTGKGPFDNLLQHLFDPWHNTIIQTLSN

SEQ ID NO: 609 - DNA, 735 bp, Oryza sativa
  CDS (1)..(735)
atggcgtccgtcaccgcccgcaccccggtcgcagccctccgctcgtcggcgtcgctcaagtctaccttcctagggcaatcctccacccgcctcgcccgcgcaccgactacgaggcgtaatgttcgggcggaggccaagggagagtggctccccggcctcccttctcccacctacctcaacggcagcttgccaggcgataacgggttcgacccgttgggtctggcggaggacccggagaacctgcggtggttcgtgcaggcggagctggtgaacgggcggtgggcgatgctgggggtggccgggatgctgctgcctgaggtgctgacgaagatcgggttgatcgacgcgccgcagtggtacgacgccggcaaggccacctacttcgcgtcgtcgtcgacgctgttcgtcatcgagttcatcctgttccactacgtggagatccggcggtggcaggacatcaagaaccctggctgcgtcaaccaggaccccatcttcaagagctacagcctcccgccgcacgagtgcggctacccggcagcgtcttcaacccccctcaacttcgagcccaccctcgaggccaaggagaaggagctcgccaacgggaggctggcgatgctggcgttcttggggttcctggtgcagcacaacgtgacgcagaaggggcccttcgacaacctgctgcagcacctgtctgacccgtggcacaacaccatcatccagacgctgtcaggctga

SEQ ID NO: 610 - protein, 244 aa, Oryza sativa
MASVTARTPVAALRSSASLKSTFLGQSSTRLARAPTTRRNVRAEAKGEWLPGLPSPTYLNGSLPGDNGFDPLGLAEDPENLRWFVQAELVNGRWAMLGVAGMLLPEVLTKIGLIDAPQWYDAGKATYFASSSTLFVIEFILFHYVEIRRWQDIKNPGCVNQDPIFKSYSLPPHECGYPAASSTPLNFEPTLEAKEKELANGRLAMLAFLGFLVQHNVTQKGPFDNLLQHLSDPWHNTIIQTLSG

SEQ ID NO: 611 - DNA, 759 bp, Beta vulgaris
  CDS (1)..(759)
atggcagcagtgacaacacaggcttcgattgccggattccggccatgcgcatcaaaatcgaggttcttgacgggtgctccaggaaaactaaacaaggaatgtggtgttagattgccctcaacttcatcaactaattctttgaaggttgaagctaagaagggagagtggttgcctggtttggcttcccctgcctatcttaatgggagtcttccaggagacaacggatttgatcccttggcattagctgaggacccagagaacttgaagtggtttgtgcaagccgagctggtgaacggccgatgggcaatgctaggggtggctggaatgttgcttccagaggtgttcacacagatcggaatcatcaacgttccgaaatggtatgatgcagggaaacaggagtactttgcctcatcatcgaccttgtttgtgattgagttcatcttattccactatgtggagataaggagatggcaggacatcaagaacccaggaagtgttaaccaagaccctatcttcaagcaatatagcttgcctcctaatgaagttggttaccctggtggcatttttaaccctctcaactttgcacctactgctgaggccaaggagaaggagcttgctaatgggagattggcaatgttggcattcttaggattcattgtgcaacacaatgtgactggaaaggggccttttgataaccttctgcagcatctatcagacccatggcacaacaccattattcagacattcggtggtaactaa

SEQ ID NO: 612 - protein, 252 aa, Beta vulgaris
MAAVTTQASIAGFRPCASKSRFLTGAPGKLNKECGVRLPSTSSTNSLKVEAKKGEWLPGLASPAYLNGSLPGDNGFDPLALAEDPENLKWFVQAELVNGRWAMLGVAGMLLPEVFTQIGIINVPKWYDAGKQEYFASSSTLFVIEFILFHYVEIRRWQDIKNPGSVNQDPIFKQYSLPPNEVGYPGGIFNPLNFAPTAEAKEKELANGRLAMLAFLGFIVQHNVTGKGPFDNLLQHLSDPWHNTIIQTFGGN

SEQ ID NO: 613 - DNA, 759 bp, Pisum sativum
  CDS (1)..(759)
atggccaccgttactacacaagcttccgccgcgatttttgggccatgtggtttgaaatcaaggtttcttggtggttcttccgggaagttgaacagaggagtggcttttaggcctgttggatgttcaccttctgcttcttttaaagttgaagctaagaaaggagagtggttgccaggtttggcctccccaggttacctaactggcagtcttcccggagacaacggatttgatccattgggacttgcggaggatccagagaatttgaggtggtttgttcaagccgagctagtgaacgggcgatgggcaatgttgggtgttgcagggatgttactccctgaggtattcacaagcattggaatcatcaatgttccgaaatggtatgccgcagggaaagaagaatactttgcttcatcttcaacactcttcgtgatcgagttcattttgtcccattatgtcgagattagaagatggcaagacattaaaaaccctggcagtgttaaccaagatcctatctttaagcaatacagcttgcccgcaggcgaggttggttaccctggcgggatctttaatcctttgaacttcgcaccaactttggaggctaaagagaaggaaattgcaaatgggagattggcaatgttggcattcttgggatttataattcagcacaatgtgacaggaaaaggaccatttgataacttgttgcagcacatttctgatccatggcacaacaccattgttcaaacactgggtggaaactag

SEQ ID NO: 614 - protein, 252 aa, Pisum sativum
MATVTTQASAAIFGPCGLKSRFLGGSSGKLNRGVAFRPVGCSPSASFKVEAKKGEWLPGLASPGYLTGSLPGDNGFDPLGLAEDPENLRWFVQAELVNGRWAMLGVAGMLLPEVFTSIGIINVPKWYAAGKEEYFASSSTLFVIEFILSHYVEIRRWQDIKNPGSVNQDPIFKQYSLPAGEVGYPGGIFNPLNFAPTLEAKEKEIANGRLAMLAFLGFIIQHNVTGKGPFDNLLQHISDPWHNTIVQTLGGN

SEQ ID NO: 615 - DNA, 735 bp, Oryza sativa
  CDS (1)..(735)
atggcgtccgacaccgcccgcaccccggtcgcagccctcctctcgtcggcgtcgctcaagtctaccttcctagggcaatcctccacccgcctcgcccgcgcaccgactacgaggcgtaatgttcgggcggaggccaagggagagtggctccccggcctcccttctcccacctacctcaacggcagcttgccaggcgataacgggttcgacccgttgggtctggcggaggacccggagaacctgcggtggttcgtgcaggcggagctggtgaacgggcggtgggcgatgctgggggtggccgggatgctgctgcctgaggtgctgacgaagatcgggttgatcgacgcgccgcagtggtacgacgccggcaaggccacctacttcgcgtcgtcgaacacgctgttcgtcatcgagttcatcctgttccactacgtggagatccgccagtggcaggacatcaagaaccctggctgcgtcaaccaggaccccatcttcaagagctacagactccccagcgacgagtgcggctaccccggcagcgtcttcaaccccctcaacttcgagcccaccctcgaggccaaggagaaggagctcgccaacgggaggctggcgatgctggcgttcttggggttcctggtgcagcacaacgtgacgcagaaggggcccttcgacaacctgctgcagcacctgtctgacccgtggcacaacaccatcatccagacgctgtcaggctga

SEQ ID NO: 616 - protein, 244 aa, Oryza sativa
MASDTARTPVAALLSSASLKSTFLGQSSTRLARAPTTRRNVRAEAKGEWLPGLPSPTYLNGSLPGDNGFDPLGLAEDPENLRWFVQAELVNGRWAMLGVAGMLLPEVLTKIGLIDAPQWYDAGKATYFASSNTLFVIEFILFHYVEIRQWQDIKNPGCVNQDPIFKSYRLPSDECGYPGSVFNPLNFEPTLEAKEKELANGRLAMLAFLGFLVQHNVTQKGPFDNLLQHLSDPWHNTIIQTLSG

SEQ ID NO: 617 - DNA, 1115 bp, Glycine max
  CDS (207)..(965)
  misc_feature (24)..(24): n is a, g, c or t
  misc_feature (25)..(25): n is a, g, c or t
  misc_feature (26)..(26): n is a, g, c or t
  misc_feature (31)..(31): n is a, g, c or t
  misc_feature (33)..(33): n is a, g, c or t
  misc_feature (40)..(40): n is a, g, c or t
  misc_feature (42)..(42): n is a, g, c or t
  misc_feature (57)..(57): n is a, g, c or t
  misc_feature (63)..(63): n is a, g, c or t
  misc_feature (79)..(79): n is a, g, c or t
  misc_feature (83)..(83): n is a, g, c or t
  misc_feature (84)..(84): n is a, g, c or t
ccccccccccgacacgtcaccggnnnggacncngttcggncnggccacttgtcctangaccgncgcgtcggcgcacacncctnncactaataggggtaactataaagttctggtagccctccactctgcgtgtgggtcgggccgactactagcactcttatgttttcttaaaatttcttccttgccactgccagtgtgtcaccaccatggccaccgtcacaacccaagcctccgccgcgattttccggccatgtgcctcgaaatcgaggtttctgaccggctcttccggtaaactcaaccgggaagtgactatgaggccaatggggtgccctccttctgcctctttcaaggttgaagccaagaagggagagtggttacctggcttggcctccccaacttacctcaatggcactcttcctggtgacaatggatttgaccctctgggactagctgaggacccagagaacttgaggtggtacgttcaagccgagcttgtgaatggacgttgggccatgttgggtgttgcaggaatgctacttcctgaggttttcaccaagattggaatcatcaatgcccctcaatggtatgatgctgggaaatcggagtactttgcttcatcgtcgaccctctttgtgatcgagttcatcttgttccactacgtcgagatccggagatggcaggacatcaagaaccctggctctgtcaaccaagaccccatcttcaagcaatacagcttgccccaacatgagtgtggataccctggtagtgtgtttaaccccttgaactttgcacctactttggaggccaaggagaaggaacttgccaatgggagattggctatgttggcattcttgggattcatagttcaacacaacgtgacaggcaaaggaccatttgagaacctattgcagcacctctctgacccgtggcacaacaccatcatcaataccattcgtggctactaagtttgtatccaatgacatggataagcctgtgtccttctcgtgtaatcctgaatggatgaattttgagagtgatttgggccaaaaaaaaaaaaaaaaaaaaaaaaaaaaaaaaaaaaaaaaaaaaaaaaaaaaaaaaaaaaaaaaaaaaaa

SEQ ID NO: 618 - protein, 252 aa, Glycine max
MATVTTQASAAIFRPCASKSRFLTGSSGKLNREVTMRPMGCPPSASFKVEAKKGEWLPGLASPTYLNGTLPGDNGFDPLGLAEDPENLRWYVQAELVNGRWAMLGVAGMLLPEVFTKIGIINAPQWYDAGKSEYFASSSTLFVIEFILFHYVEIRRWQDIKNPGSVNQDPIFKQYSLPQHECGYPGSVFNPLNFAPTLEAKEKELANGRLAMLAFLGFIVQHNVTGKGPFENLLQHLSDPWHNTIINTIRGY

SEQ ID NO: 619 - DNA, 2257 bp, Glycine max
  CDS (978)..(1736)
  misc_feature (17)..(17): n is a, g, c or t
tctattataaaaaatanggggagaaccccctaaaaagggagaccccccctatttaaaatttccggggaaaaaccgcccacacggcgaaaaaaggaaaggaaaaaaacaaaagaagcggggctaaggcgcctggcaaagtaaagggttcccttgggggtaaccccccacccccccgggtttaaatgcccctttaagggggggtcccatttcccattaaggttggccaaattttggaaagggggatcggggggggcctttttctttttaccccacctgggaaaagggggattttttccaagggaattaaattggggaaccccagggtttttccattcccaccgttttaaaaaacgggccaggaagggggggtaatacaccccccaaaaggggaaattggggcccgggcccccccccaagatttttttttttttttttttttttttttttttttttttttttttttttttttttttttttttttttttttttttttttttttttttttttttttttttttttttttttttttttagacagaagataagaagcatgcattaactttcaaggaaagcaatacatcagaatggtactgttcatcaagactctcatctcaaagaacgtaaccatagcaaagctagcttaaactacacactgatgatgacactgatacattagggttccagattattttgttaacataattttctggttcccctccgaggccgtacgtgcatgccctcatatggcctcgtcctggagcttctttctccctcgtgcttcttcagctccgttaattggtggttgcctcctcagggtccacatgaccaaacaccacaatgttgatctgagccttttccttagccatcttgcaaattaacttcgaattcggaagacctaaggtatgcagtgtggaaactcagtagcaagcttaattgttttcttcatatcttccttgtcactgcccgtgtgtcgccgccatggccaccgtcaccacccaagcctccgccgcaattttccggccatgtacctcgaaatcgaggtttttgaccggctcttccggtaaacttaaccgggaagtgactatgcggccaatggggtgccctccttctgcctctttcaaggttgaagccaagaagggagagtggttacctggcttggcctccccaacttacctcaatggcactcttcctggtgacaatggatttgaccctctggggctagctgaggacccagagaacttgaggtggtacgttcaagccgagcttgtgaatggacgttgggccatgttgggtgttgcaggaatgttgcttcctgaggttttcaccaagtttggaatcatcaatgcccctcaatggtatgatgctgggaaatcagagtactttgcatcttcctcaaccctcttcgtgatcgagttcatcttgttccactacgtcgagatccgaagatggcaggacatcaagaaccctggctgtgtcaaccaagaccccatcttcaagcaatacagcttgcccccacatgagtgtggataccctggtagtgtgttcaaccccttgaactttgcacctactttggaggccaaggagaaggaacttgccaatgggagattggctatgttggcattcttgggattcatagttcaacacaacgtgacaggcaaaggaccatttgagaacctcttgcagcacctctctgacccgtggcacaacaccatcatcaatacaattcgtggctactaagtttgtatccaatgacatggataagcctgtgtccttctcgtgtaatcctgaatggatgaattttgagagtgatttgggcgtgattgttgtgatccatctattttcatgtacagaggaactacgatggttttatattgttatttagactgtccatcaatcagtaatcaagcatgatactttctaaaaatttcatcaaaattctaatacaacatttcaaaagtatgtaaaaaaaaaaaacttccattttttacaaatttcaaatttacaacttagatcaccaaatcagatttcaaaactctaccaccaatatacaagtcagtcaaaatagctgaaatatttgtatgtggacgaactgtagtcctacaagtcttgtacaatatatgcagcaaacacatttggtggctaaaactaaatcccatcccaaatgaactccattcacctcatagatggagcaagaatagtgataagagcaattctaatatgacgtagataatattaactattatttgagtaattataca

SEQ ID NO: 620 - protein, 252 aa, Glycine max
MATVTTQASAAIFRPCTSKSRFLTGSSGKLNREVTMRPMGCPPSASFKVEAKKGEWLPGLASPTYLNGTLPGDNGFDPLGLAEDPENLRWYVQAELVNGRWAMLGVAGMLLPEVFTKFGIINAPQWYDAGKSEYFASSSTLFVIEFILFHYVEIRRWQDIKNPGCVNQDPIFKQYSLPPHECGYPGSVFNPLNFAPTLEAKEKELANGRLAMLAFLGFIVQHNVTGKGPFENLLQHLSDPWHNTIINTIRGY

SEQ ID NO: 621 - protein, 256 aa, Artificial sequence
  Description of artificial sequence: consensus sequence
  Variant (3)..(3): Xaa in position 3 is any amino acid
  Variant (6)..(7): Xaa in position 6 to 7 is any amino acid
  Variant (9)..(10): Xaa in position 9 to 10 is any amino acid
  Variant (12)..(13): Xaa in position 12 to 13 is any amino acid
  Variant (16)..(18): Xaa in position 16 to 18 is any amino acid
  Variant (19)..(23): Xaa in position 19 to 23 is any or no amino acid
  Variant (25)..(25): Xaa in position 25 is any amino acid
  Variant (28)..(29): Xaa in position 28 to 29 is any amino acid
  Variant (32)..(32): Xaa in position 32 is any amino acid
  Variant (33)..(33): Xaa in position 33 is any or no amino acid
  Variant (35)..(35): Xaa in position 35 is any amino acid
  Variant (37)..(42): Xaa in position 37 to 42 is any amino acid
  Variant (43)..(50): Xaa in position 43 to 50 is any or no amino acid
  Variant (52)..(52): Xaa in position 52 is any amino acid
  Variant (54)..(54): Xaa in position 54 is any amino acid
  Variant (58)..(58): Xaa in position 58 is any amino acid
  Variant (66)..(66): Xaa in position 66 is any amino acid
  Variant (69)..(69): Xaa in position 69 is any amino acid
  Variant (72)..(72): Xaa in position 72 is any amino acid
  Variant (74)..(74): Xaa in position 74 is any amino acid
  Variant (96)..(96): Xaa in position 96 is any amino acid
  Variant (120)..(120): Xaa in position 120 is any amino acid
  Variant (123)..(123): Xaa in position 123 is any amino acid
  Variant (125)..(125): Xaa in position 125 is any amino acid
  Variant (128)..(128): Xaa in position 128 is any amino acid
  Variant (130)..(130): Xaa in position 130 is any amino acid
  Variant (137)..(138): Xaa in position 137 to 138 is any amino acid
  Variant (170)..(170): Xaa in position 170 is any amino acid
  Variant (179)..(179): Xaa in position 179 is any amino acid
  Variant (184)..(185): Xaa in position 184 to 185 is any amino acid
  Variant (192)..(193): Xaa in position 192 to 193 is any amino acid
  Variant (224)..(225): Xaa in position 224 to 225 is any amino acid
  Variant (236)..(236): Xaa in position 236 is any amino acid
  Variant (252)..(252): Xaa in position 252 is any amino acid
  Variant (254)..(255): Xaa in position 254 to 255 is any amino acid
MAXVTXXAXXAXXRPXXXXXXXXSXFLXXSSXXLXRXXXXXXXXXXXXXXSXKXEAKXGEWLPGLXSPXYLXGXLPGDNGFDPLGLAEDPENLRWXVQAELVNGRWAMLGVAGMLLPEVXTKXGXINXPXWYDAGKXXYFASSSTLFVIEFILFHYVEIRRWQDIKNPGXVNQDPIFKXYSLPXXECGYPGXXFNPLNFAPTLEAKEKELANGRLAMLAFLGFXXQHNVTGKGPFXNLLQHLSDPWHNTIIXTXXG

SEQ ID NO: 622 - protein, 59 aa, Artificial sequence
  Description of artificial sequence: amino acid sequence pattern comprised in a variant of SEQ ID NO: 592
  Variant (6)..(6): Xaa in position 6 is Ala, Glu, Gln or Ser
  Variant (7)..(7): Xaa in position 7 is Glu, Gln or Thr
  Variant (18)..(18): Xaa in position 18 is Ile or Val
  Variant (39)..(39): Xaa in position 39 is Cys or Ser
  Variant (48)..(48): Xaa in position 48 is Gln or Ser
  Variant (53)..(54): Xaa in position 53 to 54 is any amino acid
  Variant (55)..(55): Xaa in position 55 is Glu or Lys
  Variant (56)..(56): Xaa in position 56 is Cys or Val
YDAGKXXYFASSSTLFVXEFILFHYVEIRRWQDIKNPGXVNQDPIFKXYSLPXXXXGYP

SEQ ID NO: 623 - protein, 57 aa, Artificial sequence
  Description of artificial sequence: amino acid sequence pattern comprised in a variant of SEQ ID NO: 592
  Variant (4)..(4): Xaa in position 4 is Ala or Glu
  Variant (7)..(7): Xaa in position 7 is any amino acid
  Variant (28)..(28): Xaa in position 28 is Ile, Leu or Val
  Variant (29)..(29): Xaa in position 29 is Ile or Val
  Variant (35)..(35): Xaa in position 35 is Gly or Gln
  Variant (40)..(40): Xaa in position 40 is Asp or Glu
  Variant (47)..(47): Xaa in position 47 is any amino acid
  Variant (55)..(55): Xaa in position 55 is Ile or Val
  Variant (56)..(56): Xaa in position 56 is Asn or Gln
LNFXPTXEAKEKELANGRLAMLAFLGFXXQHNVTXKGPFXNLLQHLXDPWHNTIXXT

SEQ ID NO: 624 - protein, 12 aa, Artificial sequence
  Description of artificial sequence: amino acid sequence pattern comprised in a variant of SEQ ID NO: 592
  Variant (2)..(2): Xaa in position 2 is any amino acid
  Variant (3)..(5): Xaa in position 3 to 5 is any or no amino acid
  Variant (7)..(7): Xaa in position 7 is Phe or Leu
  Variant (9)..(9): Xaa in position 9 is Ala or Val
SXXXXSXKXEAK

SEQ ID NO: 625 - DNA, 1611 bp, Arabidopsis thaliana
  CDS (1)..(1611)
atgaacgccgccgtgtttagtccttctgctttatctctccctatctccttctctaaaacccgatcctcttttctctccagaaagaagggcgtgaaaggagaatttagggtatttgctgtgtttggtgatgagagtggattagttgagaagaagagtcaatggagacctttgtttgatgtggaggatcctagatcaaaagctcctccttataaaggaaagtttttagatgttaatcaagctattgaagttgctaggtttgatattcaatacttggattggcgtgctcgtcaagatcttcttaccattatgattcttcatgacaaggttgttgatgtacttaatcctctagctcgtgagtacaagtccatcggtacagtgaagaaagaactagctggattgcaggaagaattatcgaaagcacaccaacaggttcatatatctgaagcaagggtttcgactgctttagacaagttagcccacatggaagaattggttaatgataggttgttacctggcagagttgtaacggaattagataaaccctcctcttcaaccactgcttctgctgtcgagttagatagggaaaagacaaacacgggtgcgaaaagcttgaatgtttctggtccggttccgccttatagtccacacttgaagaatttttggtatcccgttgctttcactgcagatctcaagcatgatacaatggtaccaattgaatgctttgaacaaccatgggttatctttaggggtgaagacgggaaaccaggatgtgtacggaatacatgtgcgcatagagcatgtcctcttgatcttggcacagtgaacgagggacgtattcaatgtccgtaccatggatgggaatactcaaccgatggagaatgtaagaagatgccgtctacaaagttactgaaggtgaagatcaaatcattaccttgtcttgaacaagaaggtatgatctggatttggcccggtgatgagccacctgcacctatacttccttctttacagcctccatcagggtttttaattcatgctgagcttgtaatggacctcccggtggaacacggtttacttctagataatctcttggatcttgctcatgccccattcactcatacatccacttttgcaaaaggctggagtgtcccaagtttggtgaagtttttaacacctacctcgggtctccaaggatactgggatccatatccaatcgatatggaatttaaaccaccgtgtattgttttatcgacaatcgggatatcaaaacccgggaaactagaaggcaaaagcacacagcagtgtgcaacacatcttcatcaactccatgtctgtttaccttcttctaaaaacaagacaagacttctataccgaatgtcactagactttgctcctatattaaagaatcttccattcatggaacatctgtggagacatttcgctgaacaggtcttaaacgaagatctacggctagttttaggacaacaagaacggatgttaaacggagcaaacatatggaatttaccagttgcttatgacaagctcggagttcggtatagactatggaggaacgcagtagatcgtggcgatgataaactacctttctccggctaa

SEQ ID NO: 626 - protein, 536 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNPLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPSLVKFLTPTSGLQGYWDPYPIDMEFKPPCIVLSTIGISKPGKLEGKSTQQCATHLHQLHVCLPSSKNKTRLLYRMSLDFAPILKNLPFMEHLWRHFAEQVLNEDLRLVLGQQERMLNGANIWNLPVAYDKLGVRYRLWRNAVDRGDDKLPFSG

SEQ ID NO: 627 - DNA, 2132 bp, Sorghum bicolor
  CDS (118)..(1746)
aaaaactagacgcacgcggcttctttttcccgattttcgttttttcttttctcttggattggattcaccctgctcaaaacttcggcggcggcagtagcggcgccggcgaccttctccatgaacacggtgtcttcgctgtctttggtgccgcacctgctcattaagccctccatcgcctgcttctccagaaagggcgttggccgctatggcggaatcaaggtgtacgccgtgctcagggaagacggagctgagttcgccaagaacaacaacctggaggccctgttccatgtggatgaccccgggccgaggtgccccatcaagaagggcaagttcctggatgtgaacgaggcactcgaggtggtccgattcgacatccagtactgcgactggagggcgcgccaggatctcctcaccatcatgcttctccacaacaaggtggtggaggttctcaatcccttagcgagggagttcaagtcgatcggaaccttgaggaaagagcttgccgagctgcagcaggagctggaaaaagctcacaatcaggtccatctatctgaagctagagtttcatctgcactcgacaagctagcgcatatggagaccctggtgaacgacaggctattgccaccagatggagcctccggtacttccacagccgagtccacttccctggttccaagcacatcgtccaccgcccatgtccgagccaagaaacagccacgtcggagtcttaacgtgtccggcccagtgaagccgtacaatcccagcctgaagaacttctggtacccagttgccttctccagtgatctgaaggatgacaccatggtgccgatagattgtttcgaggagcagtgggtgatattccgaggaaaagatggaaggcctgggtgtgttcagaacacatgtgctcacagagcttgcccactgcatcttggttcagtgaacgagggtagaatccagtgcccttaccatggttgggagtattcaactgatgggaaatgtgaaaaaatgccatcaacaaagatgctcaacgtgcgcatccagtcattgccatgctttgagcaggaaggaatggtttggatttggcctggggatgatccaccaaaggctacaatcccttctttgctgcctccttcaggatttacgattcacgcagagatagtgatggaactaccagttgaacatggactcctcctggataatctcttggaccttgctcatgctccttttacacacacatccacctttgccaagggctggagtgttccaagcttggtgaagttcttaacacctgcgtcggggctccaagggtactgggatccttacccgatcgacatggaattccgaccaccgtgtatggtcttgtcgaccatcgggatctcaaagcctggaaagctagaagggaagagcacccagcaatgttctacacatctccaccaactccatgtctgcttgccctcctctaggaataaaactaggctgctgtaccggatgtcactagactttgctccatggctcaagcacgtaccgctcatgcacctgctgtggtcacatttcgcagagaaggtgttgaacgaggacctacggcttgttcttggtcagcaagagcgaatgatcaatggcgccaacatctggaactggccggtatcatatgacaagctcgggatccggtatcgattgtggagggacgccgttgagcggggctctgaccggttgccattcagtaaccaagccgagagtggatcatagccggtagtctctttcttcctcgtcgcattttttcgcgagacgacggacggccagaattagttaccatggcgtgcgtctctgcgcggccagatgctgctgtgccttgaaggattctctatctggaaggtgaaagctgatggagaggatgatgggaaacatcatggtctcttctctggtgtagcaatgtacactagcgacggcatcgtgggatgcaattgtgatctgagattgatgtcttttttttttctctctctctcttcttttttttcacccttttgtgtaaagattcagcaaatgttactctgtcaaagcatgtataatcatactaccaactacggagacatgttcatatgagaaatggcagtcgtctaatcgagttgcacatt

SEQ ID NO: 628 - protein, 542 aa, Sorghum bicolor
MNTVSSLSLVPHLLIKPSIACFSRKGVGRYGGIKVYAVLREDGAEFAKNNNLEALFHVDDPGPRCPIKKGKFLDVNEALEVVRFDIQYCDWRARQDLLTIMLLHNKVVEVLNPLAREFKSIGTLRKELAELQQELEKAHNQVHLSEARVSSALDKLAHMETLVNDRLLPPDGASGTSTAESTSLVPSTSSTAHVRAKKQPRRSLNVSGPVKPYNPSLKNFWYPVAFSSDLKDDTMVPIDCFEEQWVIFRGKDGRPGCVQNTCAHRACPLHLGSVNEGRIQCPYHGWEYSTDGKCEKMPSTKMLNVRIQSLPCFEQEGMVWIWPGDDPPKATIPSLLPPSGFTIHAEIVMELPVEHGLLLDNLLDLAHAPFTHTSTFAKGWSVPSLVKFLTPASGLQGYWDPYPIDMEFRPPCMVLSTIGISKPGKLEGKSTQQCSTHLHQLHVCLPSSRNKTRLLYRMSLDFAPWLKHVPLMHLLWSHFAEKVLNEDLRLVLGQQERMINGANIWNWPVSYDKLGIRYRLWRDAVERGSDRLPFSNQAESGS

SEQ ID NO: 629 - DNA, 1560 bp, Oryza sativa
  CDS (1)..(1560): Japonica cultivar group
atgcagggcattggtcgtcgatatggaagaatcaaggtgtatgcagtgctcggtgatgatgaagctcaacatgccaagaacaacatgaggggggccttgttccatgtcgataaccccgggccaatggctcccattgcaaaaggcaacttcttggatgttaaccaggcccttgaggtggtccgattcggcatccagtactgcgattggagggcgcggcaggacctcctcaccatcatggttctgcacaacaaggtggtagaggttctcaaatctttagcaatagagttcaagtcaaatggaaccttgaggaaagagcttgcagagttgcaggaagaattggccaaagctcacaatcaggttcatttatcagaaactagagcatcatctgcacttgataagttagcacaagcggataacctggtgaatgacagactgttgcaagacggaggctctagtgcatctatagacaactatgtttctcttgcttcaagaacgtcatcagcgtcccgttttgtgaacaagaaaactctgcgtccgagtctggacgtgtctggtccagtgcagccatacaatcccaatctgaaaaacttctggtacccagttgtcttctccggtgacctgaaagatgatacaatggtaccaatagattgttttgaggagcagtgggtaattttccgaggaaaggatgggagacctggatgtgttcagaacacatgtgctcacagagcctgccctcttcatcttggctcagttagtgagggtagaatccaatgccctttccatgggtgggagtattcaactgatggaaaatgtgagaaaatgccagccacgaagttgctcaatgtgcgcatccggtcattgccatgctttgagcaagaaggcatggtttggatctggcctggtgatggcacaccggagtcgactatcccttctctgcagcccccttcaggatttacaattcatgcagagatggtgatggagctaccggtggagcatggacttctgctggacaatctattagatattgctcatgctccttttgctcatacgtccacctttgccaagggttggagtgttccaagcttggtgaagttcttgacacctgcatctgggctccaagggtactgggatccttaccccatcgacatggagtttcgaccgccatgcatggtcttgtcaaccactggcatctcaaagcctggaaaactagagggaaagagcatcaagcaatgttccacacatctccaccaactccatatctgcttgccctcctccaggaataaaaccaggatgctgtaccagatgtccctcaactttgctccctggctcaagcacatccctttcatgcacatactatggtcacattttggtgagaaggtcttgaatgaggacctacggcttgtgcttgggcagcaagagcggatgataaatggcgcgaacgtatggaactggccagtgtcatatgacaagcttggtatccggtatcggttatggagagacgccattgagaggggagcaaacaggttgccattcaataaccaaagtgagagtggatcatag

SEQ ID NO: 630 - protein, 519 aa, Oryza sativa
  Japonica cultivar group
MQGIGRRYGRIKVYAVLGDDEAQHAKNNMRGALFHVDNPGPMAPIAKGNFLDVNQALEVVRFGIQYCDWRARQDLLTIMVLHNKVVEVLKSLAIEFKSNGTLRKELAELQEELAKAHNQVHLSETRASSALDKLAQADNLVNDRLLQDGGSSASIDNYVSLASRTSSASRFVNKKTLRPSLDVSGPVQPYNPNLKNFWYPVVFSGDLKDDTMVPIDCFEEQWVIFRGKDGRPGCVQNTCAHRACPLHLGSVSEGRIQCPFHGWEYSTDGKCEKMPATKLLNVRIRSLPCFEQEGMVWIWPGDGTPESTIPSLQPPSGFTIHAEMVMELPVEHGLLLDNLLDIAHAPFAHTSTFAKGWSVPSLVKFLTPASGLQGYWDPYPIDMEFRPPCMVLSTTGISKPGKLEGKSIKQCSTHLHQLHICLPSSRNKTRMLYQMSLNFAPWLKHIPFMHILWSHFGEKVLNEDLRLVLGQQERMINGANVWNWPVSYDKLGIRYRLWRDAIERGANRLPFNNQSESGS

SEQ ID NO: 631 - DNA, 1536 bp, Arabidopsis thaliana
  CDS (1)..(1536)
atgaacgccgccgtgtttagtccttctgctttatctctccctatctccttctctaaaacccgatcctcttttctctccagaaagaagggcgtgaaaggagaatttagggtatttgctgtgtttggtgatgagagtggattagttgagaagaagagtcaatggagacctttgtttgatgtggaggatcctagatcaaaagctcctccttataaaggaaagtttttagatgttaatcaagctattgaagttgctaggtttgatattcaatacttggattggcgtgctcgtcaagatcttcttaccattatgattcttcatgacaaggttgttgatgtacttaatcctctagctcgtgagtacaagtccatcggtacagtgaagaaagaactagctggattgcaggaagaattatcgaaagcacaccaacaggttcatatatctgaagcaagggtttcgactgctttagacaagttagcccacatggaagaattggttaatgataggttgttacctggcagagttgtaacggaattagataaaccctcctcttcaaccactgcttctgctgtcgagttagatagggaaaagacaaacacgggtgcgaaaagcttgaatgtttctggtccggttccgccttatagtccacacttgaagaatttttggtatcccgttgctttcactgcagatctcaagcatgatacaatggtaccaattgaatgctttgaacaaccatgggttatctttaggggtgaagacgggaaaccaggatgtgtacggaatacatgtgcgcatagagcatgtcctcttgatcttggcacagtgaacgagggacgtattcaatgtccgtaccatggatgggaatactcaaccgatggagaatgtaagaagatgccgtctacaaagttactgaaggtgaagatcaaatcattaccttgtcttgaacaagaaggtatgatctggatttggcccggtgatgagccacctgcacctatacttccttctttacagcctccatcagggtttttaattcatgctgagcttgtaatggacctcccggtggaacacggtttacttctagataatctcttggatcttgctcatgccccattcactcatacatccacttttgcaaaaggctggagtgtcccaagtttggtgaagtttttaacacctacctcgggtctccaaggatactgggatccatatccaatcgatatggaatttaaaccaccgtgtattgttttatcgacaatcgggatatcaaaacccgggaaactagaaggcaaaagcacacagcagtgtgcaacacatcttcatcaactccatgtctgtttaccttcttctaaaaacaagacaagacttctataccgaatgtcactagactttgctcctatattaaagaatcttccattcatggaacatctgtggagacatttcgctgaacaggtaaaagtacatcacaaatggatcgatcatcttcaaccatcgtcacagtcttgtttcttaagttaccgtttctatatttccaggtcttaa

SEQ ID NO: 632 - protein, 511 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNPLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPSLVKFLTPTSGLQGYWDPYPIDMEFKPPCIVLSTIGISKPGKLEGKSTQQCATHLHQLHVCLPSSKNKTRLLYRMSLDFAPILKNLPFMEHLWRHFAEQVKVHHKWIDHLQPSSQSCFLSYRFYISRS

SEQ ID NO: 633 - DNA, 1302 bp, Arabidopsis thaliana
  CDS (1)..(1302)
atgaacgccgccgtgtttagtccttctgctttatctctccctatctccttctctaaaacccgatcctcttttctctccagaaagaagggcgtgaaaggagaatttagggtatttgctgtgtttggtgatgagagtggattagttgagaagaagagtcaatggagacctttgtttgatgtggaggatcctagatcaaaagctcctccttataaaggaaagtttttagatgttaatcaagctattgaagttgctaggtttgatattcaatacttggattggcgtgctcgtcaagatcttcttaccattatgattcttcatgacaaggttgttgatgtacttaatcctctagctcgtgagtacaagtccatcggtacagtgaagaaagaactagctggattgcaggaagaattatcgaaagcacaccaacaggttcatatatctgaagcaagggtttcgactgctttagacaagttagcccacatggaagaattggttaatgataggttgttacctggcagagttgtaacggaattagataaaccctcctcttcaaccactgcttctgctgtcgagttagatagggaaaagacaaacacgggtgcgaaaagcttgaatgtttctggtccggttccgccttatagtccacacttgaagaatttttggtatcccgttgctttcactgcagatctcaagcatgatacaatggtaccaattgaatgctttgaacaaccatgggttatctttaggggtgaagacgggaaaccaggatgtgtacggaatacatgtgcgcatagagcatgtcctcttgatcttggcacagtgaacgagggacgtattcaatgtccgtaccatggatgggaatactcaaccgatggagaatgtaagaagatgccgtctacaaagttactgaaggtgaagatcaaatcattaccttgtcttgaacaagaaggtatgatctggatttggcccggtgatgagccacctgcacctatacttccttctttacagcctccatcagggtttttaattcatgctgagcttgtaatggacctcccggtggaacacggtttacttctagataatctcttggatcttgctcatgccccattcactcatacatccacttttgcaaaaggctggagtgtcccaaggtttcttttaactctcattactctgttcagtgctaagatgaaacttggtttaagctttctgtttttggtactgcagtttggtgaagtttttaacacctacctcgggtctccaaggatactgggatccatatccaatcgatatggaatttaa

SEQ ID NO: 634 - protein, 433 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNPLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPRFLLTLITLFSAKMKLGLSFLFLVLQFGEVFNTYLGSPRILGSISNRYGI

SEQ ID NO: 635 - DNA, 1623 bp, Oryza sativa
  CDS (1)..(1623)
atgaccactgtggcatcgctgtctttgctgccgcacttgctcatcaagccttccttcaggtgttgctccagaaagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtggtagaggttcttaatcctttagcaagggagttcaagtcaattggaaccttgaggaaagagcttgcagaattacaggaagaattggcaaaagctcacaatcaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagagatagtgatggagctaccagtggagcatggacttcttctggacaatctattagatcttgctcatgctccttttactcatacatccacctttgccaagggttggagtgttccaagcttggtgaagttcttgacaccttcatctgggcttcaaggatactgggatccatacccgatcgacatggaatttcgaccaccatgcatggtgttgtcaaccattggcatctcaaagcctggaaaactagaggggaagagcaccaagcaatgttcgacgcatctccaccagctccatatctgtttgccctcctctaggaataaaaccaggctgctctaccggatgtctctcgacttcgctccatggatcaagcatgtccctttcatgcatatactatggtcacattttgctgagaaggtcttgaatgaggatcttcgagtcgtgctcgggcagcaagacggatgtcaatggcgcaaatgtctggaactggccagtatcatatgcaagcttggtatccggtatcggttgtggagagacgccattgagaggggagtagacaggttgccattcagtaaccaaagtgagagtggatcatag

SEQ ID NO: 636 - protein, 540 aa, Oryza sativa
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRVVLGQQDGCQWRKCLELASIICKLGIRYRLWRDAIERGVDRLPFSNQSESGS

SEQ ID NO: 637 - DNA, 2027 bp, Glycine max
  CDS (44)..(1636)
tctctttctctcttcagacagagactgtcagcttcgccccgccatgaacgctattgcaactgctgcagttctctctctccctttctccttctccaaatcatccaaacttgacaccaaaaagggtttaaaaggaaggtttagagtgtttgctgtatatggagaagagatagataagaagaatgcatggagtgccctctttgatgtggaggatccacgatctaaagtgccgcagtataaagggaagtttttggatgtatatcaagcccttgaagttgcaagatatgatattcaatactgtgattggcgagctaggcaagacttgcttaccatcatgcttcttcatgaaaaggtggtggaggttcttaatcctttagctcgtgattataagtccattggcaccatgaaaaaggagctagcagagttgcaggaagaattggcacaagcacaccaacaggttcatatatctgaggcaagggtgtccactgctttagataaactagcttacatggaagaattagtaaacgataagttgttgcaagaaagaaccacaaccgaagtttcccagacatcctcttctcccagtacttcttttaaacctgtagatgtagaaaagagaagaccgccacgaaaaagcttggacatatcaggtccagttcagtcataccatacccacttgaagaatttctggtaccctgtagctttctctaatgacttgaaggatgatacaatgatcccaatagaatgttttgaggaaccatgggtcatcttccgagggaaagatgggaagcctgggtgtgttcagaacacctgtgcacacagagcatgtcctctacaccttggttcggtaaatgagggtcgtatccaatgcccttaccatggctgggaatatactactgatggaaaatgtgagaaaatgccatctactcgacagctaaatgtgaaaataaagtcattgccatgctttgaaacagaggggatgatctgggtttggcctggcaatgaccccccgacggctacccttccatctttgctacctccttctgggtttgaagtgcatgctgagattgtcatggaacttccaattgaacacgggttacttttggacaaccttttggatcttgcacatgccccttttactcacacttcaacttttgctaagggatggagtgttcccagcttggtgaaatttttgacacctgcatctggcctacaaggatactgggacccctatccaattgatatggagtttcggccaccttgcatggttctatcaaccattggaatttcgaagcctggtaaactggaaggacaaagcaccagtcagtgtgccacacacctgcaccaacttcatgtctgcttaccatcttcaaaacaaaaaacaagattgctgtacagaatgtcactggattttgctcctgtgcttaagcatattccttttatgcaacatctatggagatattttgcagagcaggttttaaacgaggatctacggctagtgttaggccagcaagagcggatgaacaatggtgccaatgtgtggaatttcccagtatcctatgacaagcttgggataaggtacagactatggagaaatgccttggagcgaggaaataagcaaccacccttcagcaaatagacttgaataaagattacagtactttttatcttagtcttggaaccaactttgattaactaaaagccactcaggcacccttgcaatagaaaggccaatccacacgttgcctttcgttggttctttcagtgcattcatgcggaggaaactaaaaaatttgatcagaggctgtctcctcttattcaagccccttgtaaaaatagcacccactgtacacttagcttttattatttctgtgtacaggatcaagttcattttttaccccacttttgccatctcaactggtggcttaacctcgcgccataaaactggcgtttcttgtattatgacattaccatcttagctcaatgaaaatttgataattcagaattcgtgacaaaaaaaaaaaaaaaaa

SEQ ID NO: 638 - protein, 530 aa, Glycine max
MNAIATAAVLSLPFSFSKSSKLDTKKGLKGRFRVFAVYGEEIDKKNAWSALFDVEDPRSKVPQYKGKFLDVYQALEVARYDIQYCDWRARQDLLTIMLLHEKVVEVLNPLARDYKSIGTMKKELAELQEELAQAHQQVHISEARVSTALDKLAYMEELVNDKLLQERTTTEVSQTSSSPSTSFKPVDVEKRRPPRKSLDISGPVQSYHTHLKNFWYPVAFSNDLKDDTMIPIECFEEPWVIFRGKDGKPGCVQNTCAHRACPLHLGSVNEGRIQCPYHGWEYTTDGKCEKMPSTRQLNVKIKSLPCFETEGMIWVWPGNDPPTATLPSLLPPSGFEVHAEIVMELPIEHGLLLDNLLDLAHAPFTHTSTFAKGWSVPSLVKFLTPASGLQGYWDPYPIDMEFRPPCMVLSTIGISKPGKLEGQSTSQCATHLHQLHVCLPSSKQKTRLLYRMSLDFAPVLKHIPFMQHLWRYFAEQVLNEDLRLVLGQQERMNNGANVWNFPVSYDKLGIRYRLWRNALERGNKQPPFSK

SEQ ID NO: 639 - DNA, 2257 bp, Oryza sativa
  CDS (82)..(1707)
cctctggttgaggaaaaatatggggagtatttgtgcgtttttatttttgtttttgggtcgcactgttcgatcgtagcatccatgaccactgtggcatcgctgtctttgctgccgcacttgctcatcaagccttccttcaggtgttgctccagaaagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtggtagaggttcttaatcctttagcaagggagttcaagtcaattggaaccttgaggaaagagcttgcagaattacaggaagaattggcaaaagctcacaatcaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtccagtgcagccatacaatcccagtctgaagaacttctggtacccagttgctttctccagtgacctaaaagacgatacaatggtgccaatagattgttttgaggagcagtgggtaattttccgaggaaaggatgggagacctggatgtgttatgaacacatgtgctcacagagcttgccctcttcatcttggctcagttaatgagggcagaatccaatgcccttaccatggttgggagtattcaactgatggaaaatgtgagaaaatgccatccacaaagatgctcaacgtgcgcatccggtcattaccatgctttgagcaagaaggaatggtttggatatggcctggcaatgacccaccgaagtcgactatcccttctctgctgcctccttcaggatttacaattcacgcagagatagtgatggagctaccagtggagcatggacttcttctggacaatctattagatcttgctcatgctccttttactcatacatccacctttgccaagggttggagtgttccaagcttggtgaagttcttgacaccttcatctgggcttcaaggatactgggatccatacccgatcgacatggaatttcgaccaccatgcatggtgttgtcaaccattggcatctcaaagcctggaaaactagaggggaagagcaccaagcaatgttcgacgcatctccaccagctccatatctgtttgccctcctctaggaataaaaccaggctgctctaccggatgtctctcgacttcgctccatggatcaagcatgtccctttcatgcatatactatggtcacattttgctgagaaggtcttgaatgaggatcttcgactcgtgctcgggcagcaagaacggatgatcaatggcgcaaatgtctggaactggccagtatcatatgacaagcttggtatccggtatcggttgtggagagacgccattgagaggggagtagacaggttgccattcagtaaccaaagtgagagtggatcatagtagctgcattgccaatagcctcttttcaattcttgtcgtatttcttggcgagatgaagatgaagatgaagatgatgatggccagaactagtcagtggatgtatatgcacagtttgtttaggcgtgcgtccctgcatggttggttcaccatctccctgagcttcgttgcagattgaattgggttctggagaggaaaggctaatggaaggagagaatgataggcgacgtcattctgtgtaattttaagtgtacactagcgacagcatcacgggatgcaattgtaatctgaggttgatttgtttttcttcttttttttttcctccccttttacccatgtaaaagtcgatcgcatgtcacgctatgatgcatatatatgatcatactattgattattgagccatgaaaaaaaaagaaaaaaaaactcgagggggggcccggtacccagctttgtctaaacgtcacattccattcccattctgcttatctatttggcagattctgtgtatggtttgctaattcagaacagtaaggtctcttgataagttgagaca

SEQ ID NO: 640 - protein, 541 aa, Oryza sativa
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERMINGANVWNWPVSYDKLGIRYRLWRDAIERGVDRLPFSNQSESGS

SEQ ID NO: 641 - DNA, 2094 bp, Glycine max
  CDS (94)..(1692)
cccacgcgtccgcccacgcgtccgtacggctgcgagaagacgacagaagggggtttctcttcttttctcactcagtgtcacttcttcaccgccatgaatgctatagccactgcttctgctctctctcttccgatttttcttagagctgggaagcttgacaccaaaagggatttgaaaggtagatttagagtgtttgctgtatttggagaagaagagaagaaaaatgcatggggtgcgctttttgatgttgaggatccgagatctaagtttccacagaataaagggaaggttttggatatatctcaagcactagaagtggcaagacatgatattcagtacttagattggcgagctcggcaagatgtgctaacaatcatgcacctccatgaaaaggtggtcgaagttcttaatcctctagctcgcgaatataaatcaattggcaccctgaaaaaggagctagccgagttgcaggatgaattagcacaagcacacacacaggttcatatatctgaagcaagggttaccactgctttagataaacttgcttacatggaagaattggtaaatgataggctgttgcaagatcgaagcacgactgatgttgcccaaacatcctcttctcccagtacttctgcaaattctttagttacagaaaagagaaggcagccacggaaaagcttgaatgtatcgggtccagttcagtcataccatccccatttgaagaatttctggtatcctgttgctttttctaatgacctaaaggatgataccatgatcccaatagaatgttttgaggaaccatgggttatctttcgagggaaagatgggaagcctggatgtgtgcagaacacctgtgcacacagagcctgccctctgcaccttggttcagtaaatgagggtcgtatccaatgtccctaccatggctgggaatatactactgatggaaaatgtgagaaaatgccatctactcgacagctaaatgtgaaaataaagtcagttccatgctttgaaaaggagggaatgatctggatttggcctggcaatgaccccccagcagccacacttccatctatactacctccttcaggatttgaaatccacgctgagattgtgatggaacttccaattgaacacggcttacttttggacaatcttttggatcttgcacatgccccttttacgcacacctcaacatttgctaagggatggagtgttcccagcttggtgaattttttgacacctgcatctggcctgcaaggatactgggatccctatcctattgatatggagtttcgaccaccttgcatggtactatcaaccattggaatttcaaagcctgggaaactggagggacaaagtaccagggaatgttcaacgcacctgcaccaacttcatgtctgcttaccatcttcaaaacaaaagacaagattgctatacagaatgtcactggattttgctcctctgcttaagcatatacctttaatgaaatatctatggaggcattttgcagaacaggttttaaatgaggatctacggctagtggtggggcagcaagagagaatgaacaatggtgcaaacgtatggaatttcccagtagcctacgacaagcttggggtgagatacagaatgtggagagatgcattggagagaggagccaaacaactaccattctcaccacaacacatagattaagtacagagtgaacaatttttattttctttttctctcactcagtgatgcttcttaaatccttcgataaggaatttttcttttttcaactcaaggcttcatcatctctacaagagcttccggaaactgttgtattcatcagaggctgttcctttccctataatagtcgagtcttgacaccttttcacccttttttcattttttttaaatgtgtacagtttcaaaccatttttttccccttgtgatatctgcaccatctctcatctggtgccttaaccttacccttattcaaaggggaatgttgtctgacacaatattcagggcaatgtaatttaattcagaatacctgattggtttgggttacaacttcagacttttatatattttcaatagtgtttgttagga

SEQ ID NO: 642 - protein, 532 aa, Glycine max
MNAIATASALSLPIFLRAGKLDTKRDLKGRFRVFAVFGEEEKKNAWGALFDVEDPRSKFPQNKGKVLDISQALEVARHDIQYLDWRARQDVLTIMHLHEKVVEVLNPLAREYKSIGTLKKELAELQDELAQAHTQVHISEARVTTALDKLAYMEELVNDRLLQDRSTTDVAQTSSSPSTSANSLVTEKRRQPRKSLNVSGPVQSYHPHLKNFWYPVAFSNDLKDDTMIPIECFEEPWVIFRGKDGKPGCVQNTCAHRACPLHLGSVNEGRIQCPYHGWEYTTDGKCEKMPSTRQLNVKIKSVPCFEKEGMIWIWPGNDPPAATLPSILPPSGFEIHAEIVMELPIEHGLLLDNLLDLAHAPFTHTSTFAKGWSVPSLVNFLTPASGLQGYWDPYPIDMEFRPPCMVLSTIGISKPGKLEGQSTRECSTHLHQLHVCLPSSKQKTRLLYRMSLDFAPLLKHIPLMKYLWRHFAEQVLNEDLRLVVGQQERMNNGANVWNFPVAYDKLGVRYRMWRDALERGAKQLPFSPQHID

SEQ ID NO: 643 - protein, 498 aa, Artificial sequence
  Description of artificial sequence: consensus sequence
  Variant (2)..(3): Xaa in position 2 to 3 is any amino acid
  Variant (4)..(6): Xaa in position 4 to 6 is any or no amino acid
  Variant (8)..(10): Xaa in position 8 to 10 is any amino acid
  Variant (12)..(12): Xaa in position 12 is any amino acid
  Variant (15)..(15): Xaa in position 15 is any amino acid
  Variant (17)..(19): Xaa in position 17 to 19 is any amino acid
  Variant (20)..(23): Xaa in position 20 to 23 is any or no amino acid
  Variant (25)..(30): Xaa in position 25 to 30 is any amino acid
  Variant (33)..(33): Xaa in position 33 is any amino acid
  Variant (35)..(35): Xaa in position 35 is any amino acid
  Variant (38)..(41): Xaa in position 38 to 41 is any amino acid
  Variant (43)..(44): Xaa in position 43 to 44 is any amino acid
  Variant (52)..(52): Xaa in position 52 is any amino acid
  Variant (55)..(55): Xaa in position 55 is any amino acid
  Variant (58)..(58): Xaa in position 58 is any amino acid
  Variant (60)..(60): Xaa in position 60 is any amino acid
  Variant (65)..(65): Xaa in position 65 is any amino acid
  Variant (78)..(78): Xaa in position 78 is any amino acid
  Variant (81)..(81): Xaa in position 81 is any amino acid
  Variant (85)..(85): Xaa in position 85 is any amino acid
  Variant (94)..(94): Xaa in position 94 is any amino acid
  Variant (100)..(101): Xaa in position 100 to 101 is any amino acid
  Variant (106)..(106): Xaa in position 106 is any amino acid
  Variant (109)..(109): Xaa in position 109 is any amino acid
  Variant (112)..(113): Xaa in position 112 to 113 is any amino acid
  Variant (116)..(116): Xaa in position 116 is any amino acid
  Variant (120)..(120): Xaa in position 120 is any amino acid
  Variant (123)..(123): Xaa in position 123 is any amino acid
  Variant (127)..(127): Xaa in position 127 is any amino acid
  Variant (134)..(134): Xaa in position 134 is any amino acid
  Variant (137)..(137): Xaa in position 137 is any amino acid
  Variant (145)..(156): Xaa in position 145 to 156 is any amino acid
  Variant (157)..(158): Xaa in position 157 to 158 is any or no amino acid
  Variant (160)..(178): Xaa in position 160 to 178 is any amino acid
  Variant (181)..(181): Xaa in position 181 is any amino acid
  Variant (187)..(188): Xaa in position 187 to 188 is any amino acid
  Variant (190)..(190): Xaa in position 190 is any amino acid
  Variant (192)..(192): Xaa in position 192 is any amino acid
  Variant (203)..(204): Xaa in position 203 to 204 is any amino acid
  Variant (208)..(208): Xaa in position 208 is any amino acid
  Variant (212)..(212): Xaa in position 212 is any amino acid
  Variant (215)..(215): Xaa in position 215 is any amino acid
  Variant (219)..(220): Xaa in position 219 to 220 is any amino acid
  Variant (227)..(227): Xaa in position 227 is any amino acid
  Variant (230)..(230): Xaa in position 230 is any amino acid
  Variant (235)..(235): Xaa in position 235 is any amino acid
  Variant (246)..(246): Xaa in position 246 is any amino acid
  Variant (249)..(249): Xaa in position 249 is any amino acid
  Variant (265)..(265): Xaa in position 265 is any amino acid
  Variant (269)..(269): Xaa in position 269 is any amino acid
  Variant (271)..(271): Xaa in position 271 is any amino acid
  Variant (277)..(278): Xaa in position 277 to 278 is any amino acid
  Variant (280)..(280): Xaa in position 280 is any amino acid
  Variant (282)..(282): Xaa in position 282 is any amino acid
  Variant (284)..(284): Xaa in position 284 is any amino acid
  Variant (289)..(289): Xaa in position 289 is any amino acid
  Variant (291)..(291): Xaa in position 291 is any amino acid
  Variant (295)..(295): Xaa in position 295 is any amino acid
  Variant (301)..(302): Xaa in position 301 to 302 is any amino acid
  Variant (305)..(308): Xaa in position 305 to 308 is any amino acid
  Variant (312)..(312): Xaa in position 312 is any amino acid
  Variant (318)..(318): Xaa in position 318 is any amino acid
  Variant (323)..(323): Xaa in position 323 is any amino acid
  Variant (326)..(326): Xaa in position 326 is any amino acid
  Variant (329)..(329): Xaa in position 329 is any amino acid
  Variant (363)..(363): Xaa in position 363 is any amino acid
  Variant (368)..(368): Xaa in position 368 is any amino acid
  Variant (385)..(385): Xaa in position 385 is any amino acid
  Variant (389)..(389): Xaa in position 389 is any amino acid
  Variant (394)..(394): Xaa in position 394 is any amino acid
  Variant (405)..(405): Xaa in position 405 is any amino acid
  Variant (407)..(409): Xaa in position 407 to 409 is any amino acid
  Variant (411)..(411): Xaa in position 411 is any amino acid
  Variant (419)..(419): Xaa in position 419 is any amino acid
  Variant (425)..(425): Xaa in position 425 is any amino acid
  Variant (426)..(426): Xaa in position 426 is any or no amino acid
  Variant (430)..(430): Xaa in position 430 is any amino acid
  Variant (433)..(433): Xaa in position 433 is any amino acid
  Variant (437)..(437): Xaa in position 437 is any amino acid
  Variant (441)..(442): Xaa in position 441 to 442 is any amino acid
  Variant (444)..(445): Xaa in position 444 to 445 is any amino acid
  Variant (447)..(447): Xaa in position 447 is any amino acid
  Variant (449)..(450): Xaa in position 449 to 450 is any amino acid
  Variant (453)..(454): Xaa in position 453 to 454 is any amino acid
  Variant (456)..(456): Xaa in position 456 is any amino acid
  Variant (458)..(458): Xaa in position 458 is any amino acid
  Variant (460)..(462): Xaa in position 460 to 462 is any amino acid
  Variant (463)..(469): Xaa in position 463 to 469 is any or no amino acid
  Variant (471)..(477): Xaa in position 471 to 477 is any amino acid
  Variant (478)..(489): Xaa in position 478 to 489 is any or no amino acid
  Variant (491)..(492): Xaa in position 491 to 492 is any amino acid
  Variant (495)..(497): Xaa in position 495 to 497 is any amino acid
GXXXXXGXXXVXAVXGXXXXXXXKXXXXXXLFXVXDPXXXXPXXKGKFLDVXQAXEVXRXDIQYXDWRARQDLLTIMXLHXKVVXVLNPLAREXKSIGTXXKELAXLQXELXXAHXQVHXSEXRVSXALDKLAXMEXLVNDRLLXXXXXXXXXXXXXXSXXXXXXXXXXXXXXXXXXXSLXVSGPVXXYXPXLKNFWYPVAFXXDLKXDTMXPIXCFEXXWVIFRGXDGXPGCVXNTCAHRACPLXLGXVNEGRIQCPYHGWEYXTDGXCXKMPSTXXLXVXIXSLPCXEXEGMXWIWPGXXPPXXXXPSLXPPSGFXIHAEXVMXLPXEHGLLLDNLLDLAHAPFTHTSTFAKGWSVPSLVXFLTPXSGLQGYWDPYPIDMEFXPPCXVLSTXGISKPGKLEGXSXXXCXTHLHQLHXCLPSSXXKTRXLYXMSLXFAPXXKXXPXMXXLWXXFXEXVXXXXXXXXXXQXXXXXXXXXXXXXXXXXXXLXXRYXXXR

SEQ ID NO: 644 - protein, 60 aa, Artificial sequence
  Description of artificial sequence: amino acid sequence pattern comprised in a variant of SEQ ID NO: 626
  Variant (4)..(4): Xaa in position 4 is Ile or Val
  Variant (7)..(7): Xaa in position 7 is Asp or Glu
  Variant (11)..(11): Xaa in position 11 is Glu or Gln
  Variant (12)..(12): Xaa in position 12 is Pro or Gln
  Variant (19)..(19): Xaa in position 19 is Glu or Lys
  Variant (22)..(22): Xaa in position 22 is Lys or Arg
  Variant (27)..(27): Xaa in position 27 is any amino acid
  Variant (38)..(38): Xaa in position 38 is Asp or His
  Variant (41)..(41): Xaa in position 41 is Ser or Thr
  Variant (57)..(57): Xaa in position 57 is Ser or Thr
DTMXPIXCFEXXWVIFRGXDGXPGCVXNTCAHRACPLXLGXVNEGRIQCPYHGWEYXTDG

SEQ ID NO: 645 - protein, 60 aa, Artificial sequence
  Description of artificial sequence: amino acid sequence pattern comprised in a variant of SEQ ID NO: 626
  Variant (5)..(5): Xaa in position 5 is any amino acid
  Variant (13)..(13): Xaa in position 13 is any or no amino acid
  Variant (15)..(15): Xaa in position 15 is any or no amino acid
  Variant (19)..(19): Xaa in position 19 is any amino acid
  Variant (22)..(22): Xaa in position 22 is Asp, Glu or Asn
  Variant (26)..(26): Xaa in position 26 is Asp or Glu
  Variant (34)..(34): Xaa in position 34 is Asp or Glu
  Variant (35)..(35): Xaa in position 35 is Phe or Tyr
  Variant (41)..(41): Xaa in position 41 is Leu, Met or Val
  Variant (42)..(42): Xaa in position 42 is Lys or Arg
  Variant (47)..(47): Xaa in position 47 is Glu or Gly
  Variant (50)..(50): Xaa in position 50 is Asp, Glu or Gln
  Variant (53)..(53): Xaa in position 53 is Ala, Glu or Ser
  Variant (54)..(54): Xaa in position 54 is any amino acid
  Variant (57)..(57): Xaa in position 57 is Asn, Gln or Thr
DIQYXDWRARQDXLXTIMXLHXKVVXVLNPLARXXKSIGTXXKELAXLQXELXXAHXQVH

SEQ ID NO: 646 - protein, 39 aa, Artificial sequence
  Description of artificial sequence: amino acid sequence pattern comprised in a variant of SEQ ID NO: 626
  Variant (3)..(3): Xaa in position 3 is Ile or Leu
  Variant (6)..(6): Xaa in position 6 is Asp or Glu
  Variant (9)..(9): Xaa in position 9 is Ile or Val
AEXVMXLPXEHGLLLDNLLDLAHAPFTHTSTFAKGWSVP

SEQ ID NO: 647 - protein, 42 aa, Artificial sequence
  Description of artificial sequence: amino acid sequence pattern comprised in a variant of SEQ ID NO: 626
  Variant (2)..(2): Xaa in position 2 is Glu or Lys
  Variant (6)..(6): Xaa in position 6 is Ala or Ser
  Variant (8)..(8): Xaa in position 8 is Lys or Arg
  Variant (9)..(9): Xaa in position 9 is any amino acid
  Variant (11)..(11): Xaa in position 11 is any amino acid
  Variant (13)..(13): Xaa in position 13 is Lys or Arg
  Variant (15)..(15): Xaa in position 15 is any amino acid
  Variant (20)..(20): Xaa in position 20 is Phe or Leu
  Variant (22)..(22): Xaa in position 22 is Gln or Thr
  Variant (26)..(26): Xaa in position 26 is Ile or Val
  Variant (28)..(28): Xaa in position 28 is Ile or Val
  Variant (32)..(32): Xaa in position 32 is any or no amino acid
  Variant (34)..(35): Xaa in position 34 to 35 is any or no amino acid
  Variant (37)..(37): Xaa in position 37 is any amino acid
  Variant (38)..(38): Xaa in position 38 is Ala, Pro or Ser
  Variant (39)..(39): Xaa in position 39 is Pro or Thr
  Variant (40)..(40): Xaa in position 40 is Ile or Leu
  Variant (41)..(41): Xaa in position 41 is Leu or Pro
  Variant (42)..(42): Xaa in position 42 is Pro or Ser
CXKMPXTXXLXVXIXSLPCXEXEGMXWXWPGXDXXPXXXXXX

SEQ ID NO: 648 - protein, 28 aa, Artificial sequence
  Description of artificial sequence: amino acid sequence pattern comprised in a variant of SEQ ID NO: 626
  Variant (2)..(2): Xaa in position 2 is any amino acid
  Variant (8)..(8): Xaa in position 8 is any amino acid
  Variant (9)..(9): Xaa in position 9 is Pro or Ser
  Variant (11)..(11): Xaa in position 11 is any amino acid
  Variant (13)..(13): Xaa in position 13 is any amino acid
  Variant (22)..(22): Xaa in position 22 is Ala or Val
  Variant (24)..(24): Xaa in position 24 is Ser or Thr
  Variant (25)..(25): Xaa in position 25 is Ala, Gly, Asn or Ser
LXVSGPVXXYXPXLKNFWYPVXFXXDLK

SEQ ID NO: 649 - protein, 32 aa, Artificial sequence
  Description of artificial sequence: amino acid sequence pattern comprised in a variant of SEQ ID NO: 626
  Variant (8)..(8): Xaa in position 8 is any amino acid
  Variant (10)..(11): Xaa in position 10 to 11 is any amino acid
  Variant (12)..(12): Xaa in position 12 is Glu or Gln
  Variant (14)..(14): Xaa in position 14 is Ala or Ser
  Variant (22)..(22): Xaa in position 22 is Ile or Val
  Variant (28)..(28): Xaa in position 28 is Lys or Arg
  Variant (29)..(29): Xaa in position 29 is Asn or Gln
KPGKLEGXSXXXCXTHLHQLHXCLPSSXXKTR

SEQ ID NO: 650 - protein, 28 aa, Artificial sequence
  Description of artificial sequence: amino acid sequence pattern comprised in a variant of SEQ ID NO: 626
  Variant (17)..(17): Xaa in position 17 is Lys or Arg
  Variant (21)..(21): Xaa in position 21 is Ile or Met
  Variant (26)..(27): Xaa in position 26 to 27 is any or no amino acid
SGLQGYWDPYPIDMEFXPPCXVLSTXXI

SEQ ID NO: 651 - protein, 29 aa, Artificial sequence
  Description of artificial sequence: amino acid sequence pattern comprised in a variant of SEQ ID NO: 626
  Variant (3)..(3): Xaa in position 3 is Gln or Arg
  Variant (7)..(7): Xaa in position 7 is Asp or Asn
  Variant (11)..(11): Xaa in position 11 is any amino acid
  Variant (12)..(12): Xaa in position 12 is Ile or Leu
  Variant (14)..(14): Xaa in position 14 is any amino acid
  Variant (15)..(15): Xaa in position 15 is Ile, Leu or Val
  Variant (17)..(17): Xaa in position 17 is Phe or Leu
  Variant (19)..(20): Xaa in position 19 to 20 is any amino acid
  Variant (23)..(23): Xaa in position 23 is Arg or Ser
  Variant (24)..(24): Xaa in position 24 is His or Tyr
  Variant (26)..(26): Xaa in position 26 is Ala or Gly
  Variant (28)..(28): Xaa in position 28 is any amino acid
LYXMSLXFAPXXKXXPXMXXLWXXFXEXV

SEQ ID NO: 652 - protein, 27 aa, Artificial sequence
  Description of artificial sequence: amino acid sequence pattern comprised in a variant of SEQ ID NO: 626
  Variant (2)..(2): Xaa in position 2 is Ile or Val
  Variant (3)..(3): Xaa in position 3 is Ala or Ser
  Variant (4)..(4): Xaa in position 4 is Phe or Tyr
  Variant (5)..(5): Xaa in position 5 is Asp or Ser
  Variant (7)..(11): Xaa in position 7 to 11 is any or no amino acid
  Variant (13)..(13): Xaa in position 13 is Gly or Ser
  Variant (14)..(14): Xaa in position 14 is any amino acid
  Variant (15)..(15): Xaa in position 15 is Lys or Arg
  Variant (16)..(17): Xaa in position 16 to 17 is any amino acid
  Variant (18)..(18): Xaa in position 18 is Leu, Met or Val
  Variant (19)..(20): Xaa in position 19 to 20 is any amino acid
  Variant (21)..(21): Xaa in position 21 is Asp, Glu or Asn
  Variant (22)..(25): Xaa in position 22 to 25 is any amino acid
  Variant (26)..(26): Xaa in position 26 is Ala or Gly
  Variant (27)..(27): Xaa in position 27 is Ala, Asp, Asn, Ser or Val
PXXXXKXXXXXLXXXXXXXXXXXXXXX

SEQ ID NO: 653 - protein, 25 aa, Artificial sequence
  Description of artificial sequence: amino acid sequence pattern comprised in a variant of SEQ ID NO: 626
  Variant (3)..(3): Xaa in position 3 is Ala or Thr
  Variant (5)..(5): Xaa in position 5 is Ala or Val
  Variant (6)..(7): Xaa in position 6 to 7 is Ser or Thr
  Variant (14)..(15): Xaa in position 14 to 15 is any amino acid
  Variant (16)..(16): Xaa in position 16 is Asp or Glu
  Variant (17)..(17): Xaa in position 17 is Glu, Asn or Thr
  Variant (22)..(22): Xaa in position 22 is Lys or Arg
  Variant (25)..(25): Xaa in position 25 is Pro or Gln
SEXRXXXALDKLAXXXXLVNDXLLX

SEQ ID NO: 654 - protein, 18 aa, Artificial sequence
  Description of artificial sequence: amino acid sequence pattern comprised in a variant of SEQ ID NO: 626
  Variant (2)..(2): Xaa in position 2 is any amino acid
  Variant (3)..(3): Xaa in position 3 is any or no amino acid
  Variant (6)..(6): Xaa in position 6 is any amino acid
  Variant (7)..(7): Xaa in position 7 is Phe or Val
  Variant (10)..(10): Xaa in position 10 is Ile or Val
  Variant (11)..(11): Xaa in position 11 is any amino acid
  Variant (12)..(12): Xaa in position 12 is Glu or Gln
  Variant (14)..(14): Xaa in position 14 is Ile or Leu
  Variant (17)..(17): Xaa in position 17 is Ala or Val
PXXKGXXLDXXXAXEVXR

SEQ ID NO: 655 - protein, 16 aa, Artificial sequence
  Description of artificial sequence: amino acid sequence pattern comprised in a variant of SEQ ID NO: 626
  Variant (2)..(2): Xaa in position 2 is any amino acid
  Variant (4)..(5): Xaa in position 4 to 5 is any amino acid
  Variant (6)..(8): Xaa in position 6 to 8 is any or no amino acid
  Variant (10)..(10): Xaa in position 10 is Leu, Pro or Val
  Variant (11)..(11): Xaa in position 11 is Leu or Val
  Variant (12)..(12): Xaa in position 12 is Phe, Leu or Val
  Variant (13)..(13): Xaa in position 13 is Asp or Gly
  Variant (14)..(14): Xaa in position 14 is any amino acid
  Variant (15)..(15): Xaa in position 15 is Glu or Gln
  Variant (16)..(16): Xaa in position 16 is Asp or Glu
LXEXXXXXRXXXXXXX

SEQ ID NO: 656 - protein, 8 aa, Artificial sequence
  Description of artificial sequence: amino acid sequence pattern comprised in a variant of SEQ ID NO: 626
  Variant (4)..(4): Xaa in position 4 is any amino acid
SLVXFLTP

SEQ ID NO: 657 - DNA, 1648 bp, Arabidopsis thaliana
  CDS (31)..(1512)
gttcttacaaaacagaaccaaacttcgacaatgtcactcatgttttcttcccctgtcgtcaccccagcactcggatctttcaccttctcatctcgaccacgctccaattacatcgtgatgtccgccgtccgatctaactctgcttcgacgtgtcctatactgaccaagtttcagaaagactgcgccactcctacaccgtacctacgcaacgtagccaacgccattgctgatgacatgcgagatggtctagctgttgaaggaggaggagatctcgagatgatcttgacttttgttgacgctttgccttctgggaatgaggaagggttgttctatgcattggatttaggaggtacaaattttcgggtgcgtagcgtgcaattaggaggaaagaaagagcgagtcttagctaccgaatctgaacaaatatctatttctcaaaagcttatgattggtacaagtgaggagcttttcgggttcattgcttcaaagcttgcaaattttgttgcaaaggagaagccaggtcggtttcttttagaagaagggaggaaaagggagttagggtttaccttttcattccctgtgaagcaaacctctattgattcaggcacattaagcaagtggactaaaggctttaaagtgtctggaatggaaggaaaaaatgtggttgcttgtttaaatgaagctatggaagcacatggactcgatatgcgagtttctgctcttgtaaatgatggagtgggaacattagctggagcaaggtattgggatgaggatgtgatggtcggtgtgattcttggcactgggaccaatgcttgttatgtagaacagaaacatgcaattcctaaactccgaagcaaatcttcttctggaacaacgatcataaacactgagtggggagggttctctaagattcttccgcaaaccatttttgacctagagatggatgagacaagcctgaatcctggtgaacatttatatgagaagatgatctcagggatgtaccttggtgaaattgtaaggagggttttgctccatatgtgtgaaactagtgacttgtttggacacttcgctcctgccaaactctccactcctttggcactcaggaccgagcatctatgcaaaatgcaagaggacaatacagatgatcttcgggatgttggatcaatcctatacgactttttagatgtagaggcgaatatgaatgcaaggaggagagtggtggaagtgtgtgacacagtagtgaaacgcggagggcgtctagcaggagctggtatagtggcaattctggagaagattgaaaaagataccaaaagaatgggttcaggtaaaagaaccgttgtggctatggacggtgcactgtatgagaagtacccacaatatcgacagtatatgcaagacgcactagtcgagcttcttggccataagcttgcaagtcacgttgcgatcaaacataccaaagacgtgtctgggctcggtgctgctcttttggcggccactaactccatttactagtacttggacctctacttcatgagtataggaggacttttggtccatttgtttgtgtacatttatataagatatcatatcaatatcaataagattgtaaagaggagcaacgaactagcagaagattatgtcttggacc

SEQ ID NO: 658 - protein, 493 aa, Arabidopsis thaliana
MSLMFSSPVVTPALGSFTFSSRPRSNYIVMSAVRSNSASTCPILTKFQKDCATPTPYLRNVANAIADDMRDGLAVEGGGDLEMILTFVDALPSGNEEGLFYALDLGGTNFRVRSVQLGGKKERVLATESEQISISQKLMIGTSEELFGFIASKLANFVAKEKPGRFLLEEGRKRELGFTFSFPVKQTSIDSGTLSKWTKGFKVSGMEGKNVVACLNEAMEAHGLDMRVSALVNDGVGTLAGARYWDEDVMVGVILGTGTNACYVEQKHAIPKLRSKSSSGTTIINTEWGGFSKILPQTIFDLEMDETSLNPGEHLYEKMISGMYLGEIVRRVLLHMCETSDLFGHFAPAKLSTPLALRTEHLCKMQEDNTDDLRDVGSILYDFLDVEANMNARRRVVEVCDTVVKRGGRLAGAGIVAILEKIEKDTKRMGSGKRTVVAMDGALYEKYPQYRQYMQDALVELLGHKLASHVAIKHTKDVSGLGAALLAATNSIY

SEQ ID NO: 659 - DNA, 1997 bp, Glycine max
  CDS (243)..(1745)
ccacgcgtccggaggtgggtcactagcagtgtcccttcttcgcgatgaagagaaataccctcaaagcatcagtggtgacctctgtggtacttctcatcgcagctaaagcagaggccgcgctcacggcggctggcaatctcttcagaggtcaggcgtttgaaaggttgagtgggggaaggtggcaggaggcggcgtccgtatgggtgacggtgatgggaagatagagtagaggcaaacgtaagatgatgtctgttactgttgctgccgacactacctccgccgccgtaggatcctgtctttcacgatcgcggcggcggtgcttaacggtggctctccgatctaaagtgtcagtcaccccaaccagaatattgacgaaactcaaacacgagtgtgccactcctctgccccttcttcagcaagtggccaataacatgtcttctgacatgcgagctgggcttgctgcagaggctgggcctgggcccgggcttcccatgatacccagctatgttgaaaatcttcccactgggaatgagaaagggttgttttatgccttggatctcggaggaaccaacttccgtgtgctgagggtgcagttgggtggcaaagatgagcgtgtcattgccaccgagtttgatcaagtttccatacctcatcaactcatgtttgctacatctcaggagctgtttgatttcattgcttcggggctagcaaaatttgcgtccaaggaggatggtagatttcatatctcaccgggaaaaaagggagagattggcttcacgttttcatttcctgtgaagcaggcatctattgattctggcatactaatcaagtggaccaagggttttgcagtgtctggaacagcagggagagatgtggtggcttgtctgaacgaggcaatggaaaggcaaggaatagacatgcgagtttctgctctggtgaatgataccgtggcaacgttagctggagcagaatactgggataatgatgtcgtggttgctgtcattttgggtactggaaccaatgcttgctatgttgaacagatcagtgccattcctaagttacagggccatgtctcttcttctgggaaaatgatcattagcactgagtggggtgctttctcaaatggtctccctttaaccaagttcgatagggaaatggatgctgctagcatcaatccgggcgagcagatctttgaaaagacaatctcgggaatgtatctaggcgaaattgttagacgagtgctgctggaaatggctgaagagggtggtctgtttggaaaatctgtcccgcagacactatctacacctttcatactcgggaccccagatctatgtgccatgcagcaggacagttctggcgatttacatgcagttgggtccctcctctatgataaagcaggggttgaatccaatttaagtgaaagaaaaacagttttagaggtttgtgagacaattgtaaagcgaggtgggagcttagctggtgcaggaatagtggggattctacaaaaaatggaagaggatcagagaggtctcgtctttgggaatgggaagagaagtgttgttgccattgatgggggcttatatgaaaattatcctcaatacagggcttatttgcaagattcagtcacagagctgctaggaacagaaaagtcaaacaatgtggtgatagagcatactaaagatggatctggaataggagctgctctattggctgcttcaaactccatgtacaaccaagatttatagggaatttatttaccattatcattatcaccgagataaaaaaatttagttcatgtaccacgtatgtaattattggaacccctagtccttgattgagcattggagaggtaagaataagtgcatatttagattgcagtttttaaaagtttcaataattatttctttcaaactgaacttttaggttaaattttagtttcaaatatactttcagtgacaaaaaaattatgatgtcaaagtcaatttcctctctaaatt

SEQ ID NO: 660 - protein, 500 aa, Glycine max
MMSVTVAADTTSAAVGSCLSRSRRRCLTVALRSKVSVTPTRILTKLKHECATPLPLLQQVANNMSSDMRAGLAAEAGPGPGLPMIPSYVENLPTGNEKGLFYALDLGGTNFRVLRVQLGGKDERVIATEFDQVSIPHQLMFATSQELFDFIASGLAKFASKEDGRFHISPGKKGEIGFTFSFPVKQASIDSGILIKWTKGFAVSGTAGRDVVACLNEAMERQGIDMRVSALVNDTVATLAGAEYWDNDVVVAVILGTGTNACYVEQISAIPKLQGHVSSSGKMIISTEWGAFSNGLPLTKFDREMDAASINPGEQIFEKTISGMYLGEIVRRVLLEMAEEGGLFGKSVPQTLSTPFILGTPDLCAMQQDSSGDLHAVGSLLYDKAGVESNLSERKTVLEVCETIVKRGGSLAGAGIVGILQKMEEDQRGLVFGNGKRSVVAIDGGLYENYPQYRAYLQDSVTELLGTEKSNNVVIEHTKDGSGIGAALLAASNSMYNQDL

SEQ ID NO: 661 - DNA, 1768 bp, Zea mays
  CDS (2)..(1381)
gatgatcgaggaggtggagcgcagcctcgccacgcccacggcgctgctgcggggcatcgcggacgccatggtcgccgagatggagcgcggcctgcgcggggacatccacgcgcagctcaagatgctcattagctacgtcgacaatctccccaccggagatgaacatgggctgttttatgcactggatcttggagggaccaacttccgtgtgctgcgagtccaactaggaggaagggagaaacgtgttgtcaaacaacagtacgaggaggtttccattccaccgcatttgatggtcgggacttccattgaactatttgatttcattgctgctgcattggctaaatttgttgatactgaaggtgaagatttccacctcccagagggtaggcagagagaacttggtttcacgttttccttcccagtgaaccaaacatcaatatcatcaggaacactcatcaagtggacaaagggcttttccatcaatggcacggttggtgaagatgttgtttctgagttgagcagggccatggagaggcagggactagatatgaaagttacggcattggtcaatgatacagttggcacattggctggtgggagatatatggataacgatgtagttgcagccgtaatattgggcactggtacaaatgcagcatatgtggagcatgcaaatgcaattcctaaatggacggggttactgcctaaatctggaaacatggtaattaatacggaatggggaagctttaaatccggcaagcttcctctctcagaatacgacaaagccatggactttgaaagtttgaaccctggagagcagatatacgaaaaaatgatttctggcatgtatctgggagagattgttcgaagaattttactcaagttggcacatgacgcttctctatttggagatgttgttccaactaagctggagcagccatttatattgaggacgccagatatgtcagccatgcatcatgactcttcgcatgacctcaaaactcttggatctaaactgaaggatatagttggggtcgcagatacttccctggaagtaagatacattactcgtcacatctgcgaccttgtcgcagagcgtggagcacgcttggctgccgcaggtatatatagcatcctgaagaagataggccgggacaaagtaccaagcagtggcagtaaaatgccaaggactgtaattgccttggatggtgggctctatgagcattacaagaagttcagcagctgcgtcgaagcaactcttacagacttgctcggcgaagaggcctcttcctccgtggttgccaagctggccaacgatggctctggcattggagctgctctccttgcagcctcacactcccagtatggcgagagtgactagtcttgaaaactggtgtggatcgaacttcgagtgtagctctcatttttatctttttttcccttcaaaacatccctaatattccggctctcctcggggaatttttcggcttcctttcttggctattctgtggatgcacttaaggctctgcagcgggatatagctagtatagagccaatcagtttggaggttatctaatggcataaggtttggacggcaggaacatagaaatggaagctgaacaatgccattcatgttctgcccaatttttcttccccttgcatggtgttgtaaaccaatcaaaaaatttaacctttttttttgtgttggcaataaagaggaggacacgataatttgaccaaaaaaaaaaaaaaaaaacggacgcgtggg

SEQ ID NO: 662 - protein, 459 aa, Zea mays
MIEEVERSLATPTALLRGIADAMVAEMERGLRGDIHAQLKMLISYVDNLPTGDEHGLFYALDLGGTNFRVLRVQLGGREKRVVKQQYEEVSIPPHLMVGTSIELFDFIAAALAKFVDTEGEDFHLPEGRQRELGFTFSFPVNQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSGKLPLSEYDKAMDFESLNPGEQIYEKMISGMYLGEIVRRILLKLAHDASLFGDVVPTKLEQPFILRTPDMSAMHHDSSHDLKTLGSKLKDIVGVADTSLEVRYITRHICDLVAERGARLAAAGIYSILKKIGRDKVPSSGSKMPRTVIALDGGLYEHYKKFSSCVEATLTDLLGEEASSSVVAKLANDGSGIGAALLAASHSQYGESD

SEQ ID NO: 663 - DNA, 2342 bp, Zea mays
  CDS (585)..(2096)
tgagccgcccggcccgggagcgggaccggagtagcgccagcgtcccattcccggccaacctccctgttcatctccatgccgacctgactcggtatgataagatccatgtgatccagagcctgatccgaacacgatccctttctcccctttccctgcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaacccaaagatcctgactttctcttgctgctagcctcccttttcccttctcccttaatcgcactgttggaagctcttcgctgtcacccccacccacctccggcgctcttttttagcattttccttgggctctggactccaaaatcccagccttttgtttgcttctctgtctcctgctgattggtgtccccgggtccaggactcttgatttgctcctcgcgggggttcggtcccatggcggcagctgcgctggcaatggcagagcaggtggtggccgagctccgagtgaggtgtgagacgccgccgtcgatgctgcgcgaggtggccgtggagatggcccgcgagatgggcgcggggctggagaaggacggcgggagcagggtcaagatgctcctctcctacgtcgataagctccccacagggagagaggaaggattattctatggattggacctaggaggaacgaatttccgcgtcttgaaagtgcaactaggtgggaatgcgaagcatgtcgttgaccgtgactccagagaagtcggcattccgccacatctgatgtcagggagctcctcggagctttttggtttcattgcttctgaattggccaagtttgttgacgatgatgagaagtgcgctaacatttcgaatggcaagaagcgagaaatagggttcacgttttcgttcccagtgaagcagcgttctgtagcttccggtacgcttgtcaagtggacaaaggcattttccattaatgatgctgtaggcgaagatgtggtggctgaactgcaaacagccatggagaagcaaggtctggacatgcatgtagctgcattgattaatgatgctgttgggacgctggcgggagcaaggtactacgacaaagatgttgtcgctggtgtaatatttggcactggcacaaacgcagcatatgttgagaaggcaaatgctattccaaaatgggagggtgagctgccccattcaggagacatggtcatcaacatggaatggggtaacttcttctcatctcatctccccatcactgaatatgatcaagaattagataaggagagcttaaatccaggagaacagatttacgagaagttaacgtcaggaatgtatttaggtgaaattgtaaggagggtgctccttaaaatatcattgcagtccgccatttttggtgatattgaccacactaagcttcaaacccatttccttctgcggactccacatatttcagcaatgcaccatgacgaaacatctgatctgaagattgtggccgaaaattttgaagaaaacctagagattacaggcacatccttggaggctcgtaagctggtcgttgaaatctgtgacattgtggcgacaagagcagcccggctggctgctgcggggcttgcagggatcctcatgaagatcgggagagatcacagcgtcgaggaccaacggtcagtcatcgccatcgacggaggactgttcgagcactacaccaaattccgccggtgcttggagaccacactgggtgagctgctaggagacgaggcgtccaaggcggtggccatcaagcatgccgatgacggctcaggaataggtgctgccctgattgcagcttcacagtctcagtacaaaaacgacttagtggccgtcaagcatgcagatgacggttcaggagtcaagtatgcagaagacaagcgtgcagatgacggttcagaaataggtgctgccctgattgcagcctcgcaatctcagtagagagatgtcctgagtggtatagaggtagcaagtagctatgatttgtttccaacgtcttaactgtccagcgtctgcagtttagcatgctagagctggatgcgatctgtaaccaaaaccaggcttggccaactggctgttcataattccaataacagcagggttgcagatgtctcctaaaaaaaaaaaaaaaacaccttcccatccttcccatccctttcattgattattatcgaaaaccccaaaccc

SEQ ID NO: 664 - protein, 503 aa, Zea mays
MAAAALAMAEQVVAELRVRCETPPSMLREVAVEMAREMGAGLEKDGGSRVKMLLSYVDKLPTGREEGLFYGLDLGGTNFRVLKVQLGGNAKHVVDRDSREVGIPPHLMSGSSSELFGFIASELAKFVDDDEKCANISNGKKREIGFTFSFPVKQRSVASGTLVKWTKAFSINDAVGEDVVAELQTAMEKQGLDMHVAALINDAVGTLAGARYYDKDVVAGVIFGTGTNAAYVEKANAIPKWEGELPHSGDMVINMEWGNFFSSHLPITEYDQELDKESLNPGEQIYEKLTSGMYLGEIVRRVLLKISLQSAIFGDIDHTKLQTHFLLRTPHISAMHHDETSDLKIVAENFEENLEITGTSLEARKLVVEICDIVATRAARLAAAGLAGILMKIGRDHSVEDQRSVIAIDGGLFEHYTKFRRCLETTLGELLGDEASKAVAIKHADDGSGIGAALIAASQSQYKNDLVAVKHADDGSGVKYAEDKRADDGSEIGAALIAASQSQ

SEQ ID NO: 665 - DNA, 2069 bp, Zea mays
  CDS (342)..(1721)
aaaaaaaaaaaaaaaaaaaaaaaatgctaaaaaaaaaaaaaaaaaaaaaaaaaggtcgcgttccatcgattctccacgagcggatagcggcgtacagatcttttcgtgctcgtcttcgcgtcggtgtggctggccccccgtgagaagtcaaaatctcacagcatattgattgggctgattgattccgtgggcgggaatcggggatctggcattctcgcgcccaaaaggtcgcagctttctttcgtgtcgccagccggtgcgcggtcgacgacgcagagcgtggagggtgtcccgctagtagctcctcgacgacgacggtgacgggaggccgggggttgaccatggtggcggcggcggacctggaggcggcggagcgggtggtggcggagctccgcgaggcgtgcgcggcgcggctcgacgaggtggcggcggcgatggaggcggagatgcgcgccggactgcgcgaggagggcggcagcaagatcaagatgatcgtctccttcgtcgacaacctccccacggggaacgaagagggcgtcttctacgccttggaccttggcggaacgaacttccgcgtgctgcgcgtgcagctcgccgggaaggacaggcgtgtggccaagcgagagtccaaggaggtgtccatccctcctcacctcatgtcaggcaacgcatcggagctgtttggcttcatcgcctccgcgctagccaagtacgtcgccgcggcgggcgaaggggacggcaggcagagagagctcgggttcaccttctctttccccgtgcgccagacgtcgatcgcgtcaggcacgctcatcaagtggaccaaggcgttttcggtcgacgacgctgttggtgaggatgtcgtcgccgagctgcagacggccatggagaagcaaggcgtcgacatgcgtgtggcggcactgatcaacgatacggtcgggacgctggctgcgggccggtacaacgatgaggacgtcgtcgtcggtgtgatactaggcactggctccaacgccgcgtacgtcgaagaggccagtgccatacccaagctcaagctggagggcggcgaattgcccaagtcagggaacatggtgataaacacagaatggggtaacttctactcgccctgcctccccatcacggagtatgaccaggccttggatgaggagagcttaaacccaggggagcagatcttcgagaagctggtttcgggcatgtatctcggcgagattgtgaggcgggtgctgcttaaaatcgcgtcgcagtcttccatcttgggcgatgtcagccacacgaacctcaaaactcgcttcagtcttaggactccggacatctccgcgatgcaccatgacggcacgcctgacctgagagtcgtggcggagaagctggccgacaacctcagggtcagggacacgtccttggacacgaggaagatggtggtcgagatctgcgacatcgtcaccgggaggtctgcccggctggccgcggcggggatcgtcgggatcctcaggaagatcggtcgagcggcgccaggcgacgagcgccggtcggtcgtcgccatcgacggcggcctgttcgagcactacgccgagttcaggaagcgcctggaggccacgctggtggagctgctcggggaggaggcgtctaggctggtggaggtcaagctcaccaaggacgggtctggcctcggagccgccctcattgcagctgcccactcgcagtactgaacgcccaacggccgtgtgtgtcggtgtgcaactcgtgctgaattcctgtacgttttcaagaacaagtttgctcggaatctgccaacaagcaagtgctctaatggaaagttgctatgcggaatcctagtgagttcagggtttccaatgtttttttttttcctagagggatgggggatgtgacttcagctttccaggcagttgagacttaattgagatggagcagctgtgcctctggttcatttcccgaaaggctccaggagagaggcccagaggtccaaaacaaaatgatataagctccactttgttttaattcgagattaggcaaactaaagatattctcagggcaat

SEQ ID NO: 666 - protein, 459 aa, Zea mays
MVAAADLEAAERVVAELREACAARLDEVAAAMEAEMRAGLREEGGSKIKMIVSFVDNLPTGNEEGVFYALDLGGTNFRVLRVQLAGKDRRVAKRESKEVSIPPHLMSGNASELFGFIASALAKYVAAAGEGDGRQRELGFTFSFPVRQTSIASGTLIKWTKAFSVDDAVGEDVVAELQTAMEKQGVDMRVAALINDTVGTLAAGRYNDEDVVVGVILGTGSNAAYVEEASAIPKLKLEGGELPKSGNMVINTEWGNFYSPCLPITEYDQALDEESLNPGEQIFEKLVSGMYLGEIVRRVLLKIASQSSILGDVSHTNLKTRFSLRTPDISAMHHDGTPDLRVVAEKLADNLRVRDTSLDTRKMVVEICDIVTGRSARLAAAGIVGILRKIGRAAPGDERRSVVAIDGGLFEHYAEFRKRLEATLVELLGEEASRLVEVKLTKDGSGLGAALIAAAHSQY

SEQ ID NO: 667 - DNA, 1801 bp, Zea mays
  CDS (117)..(1631)
cattgggtacctcgaggccggccgggccagtgaaccagtcaccaactcccgtggcagtgataccgttgactgctgagctgtcagcctgaagccgaggggcaaacgcaacgtcgccgatgcggaagccggcggcactggtggtttctacggcggttttcgcagccgcagccgtagccgccgtgatggcacgccagaggttgcgggaagcgaggcgatgggcacgcgcaggcgccgtgctgcgggacctgcaggagcggtgcgcggcgccggtggagcggctgcggcaggtggcagacgcgatggtcgcggagatgcgcgcggggctggcctccaacgactccgagggagatagcgggagcagcgtcctcctcaagatgctcgtaacctacgttgactccctaccgtccggggacgagaaagggctattttatgctcttgaccttggcggaacaaactttcgtgttttacgaattcagtttgggggcaaggaacaacgaatagtcaagcaagaatctaaaacggtatccattcctcaacatttaatgtccaggggatcaaatgagctgtttgattttattgctgctgctttagcgaagttcattgcctctgagggtgagggcttttatcttcctgagggcatgcaaagacaacttggttttacattctcctttccagtgaagcaaaattcagttgcatctggtactcttatcaaatggacaaagggttttgcaattgatgaaatggtaggaaaggacgtagtggcagaattaaacaaggctatcaaacgccaaggagttgatatggaagtcacagtactggtcaatgatacagtagggacattggctgctgggagatatgtggataatgatactgttgctgcagttatactgggtactggcactaatgcagcgtacatagaacatatggactcaattcctaaatggtgtggcccacctcctgagtctggaaacatggtgataaacatggaatgggggaactttaggtccacccaccttccactgactgaatttgatgtagccttggatgcagaaagtttgaaccctgatgaacagatttatgagaagttgatctctggcatgtatatgggggaaattgtccgaagggtcttgctaaaaatggctcaggatgcttctcttttctcagataatgtacctctggaacttgaggtcccatatatccttagaacatatcacgtgctgatgatgcatcaagacacatcgcctgatctcagaacggttggcaacaagctgaaagaagtcttcaggatagaagacacctgtttcaaaacaaggaaattggtagtggatgtctgcgaggttgttgccagtcgcgctgcacgacttgctgctgctgggatacacggcatcctcaaaaagcttgggcgagacgttgccagcccagacaaacaaaagacggtgattgctgtggatggcggagtttacaagcattatactttcttcgcccagtgcatggagagcactcttagagacttgcttggggagggagtggcgtcctctttagtgataaaacttgccgaagatggctcaggcactggagcggcgctcttgtcagcctcctattctcaacgtctccaggccgtggatgattaatttctgcttgtagttccttcagattctgaaggtatagcaggtatacaattgctccagtggatatttgtctataacggttataacattcaactgccacattcttttttctgtcaggcctgtgctcctgcagtgcccatttttaaggggttgtacacgtcacttaagactcc

SEQ ID NO: 668 - protein, 504 aa, Zea mays
MRKPAALVVSTAVFAAAAVAAVMARQRLREARRWARAGAVLRDLQERCAAPVERLRQVADAMVAEMRAGLASNDSEGDSGSSVLLKMLVTYVDSLPSGDEKGLFYALDLGGTNFRVLRIQFGGKEQRIVKQESKTVSIPQHLMSRGSNELFDFIAAALAKFIASEGEGFYLPEGMQRQLGFTFSFPVKQNSVASGTLIKWTKGFAIDEMVGKDVVAELNKAIKRQGVDMEVTVLVNDTVGTLAAGRYVDNDTVAAVILGTGTNAAYIEHMDSIPKWCGPPPESGNMVINMEWGNFRSTHLPLTEFDVALDAESLNPDEQIYEKLISGMYMGEIVRRVLLKMAQDASLFSDNVPLELEVPYILRTYHVLMMHQDTSPDLRTVGNKLKEVFRIEDTCFKTRKLVVDVCEVVASRAARLAAAGIHGILKKLGRDVASPDKQKTVIAVDGGVYKHYTFFAQCMESTLRDLLGEGVASSLVIKLAEDGSGTGAALLSASYSQRLQAVDD

SEQ ID NO: 669 - DNA, 2008 bp, Zea mays
  CDS (148)..(1671): subsp. mays
aaagaagtagtagtagttcgctggaggagttggcctcgtcctcggatccagagcgcggaaacccgtgcgcgcgtccggatcgacccgctcgctcgacggccgcgggcgcgaggctagggatcaggatcggcggcggcggcggcggcgatggggaagtccgtggtggtgggcgcggcggtcgtggcgtgcgcggcggtgggggtggcggcggtgctggtgcaccgccggcgcaggcgcgacgccgcgctcctggggtccgcggaggcggagaggaggcggcgcgcggccgccgtgatcgaggaggtggagcgcagcctcgccacgcccacggcgctgctgcggggcatcgcggacgccatggtcgccgagatggagcgcggcctgcgcggggacatccacgcgcagctcaagatgctcattagctacgtcgacaacctccccaccggagatgaacatgggctgttttatgcactggatcttggagggaccaacttccgtgtgctgcgagtccaactaggaggaagggagaaacgtgttgtcaaacaacagtacgaggaggtttccattccaccgcatttgatggttgggacttccattgaactatttgatttcattgctgctgcattggctaaatttgttgatactgaaggtgatgatttccacctcccagagggtaggcagagagaacttggtttcacgttttccttcccggtgaaccaaacatcaatatcatcaggaacactcatcaagtggacaaagggcttttccatcaatggcacggttggtgaagatgttgtttctgagttgagcagggccatggagaggcagggactagatatgaaagttacggcattggtcaatgatacagttggcacattggctggtgggagatatatggataacgatgtagttgcagccgtaatattgggcactggtacaaatgcagcatatgtggagcatgcaaatgcaattcctaaatggactgggttactgcctaaatctggaaacatggtaattaatacggaatggggaagctttaaatccggcaagcttcctctctcagaatatgacaaagccatggactttgaaagtttgaaccctggagagcagatatacgaaaaaatgatttctggcatgtatctgggagagattgttcgaagaattttactcaagttggcacatgacgcttctctatttggagatgttgttccaactaagctggagcagccatttatattgaggacgccagatatgtcagccatgcatcatgactcttcgcacgacctcaaaactcttggatctaaactgaaggatatagttggggtcgcagatacttccctggaagtaagatacattactcgtcacatctgcgaccttgtcgcagagcgtggagcacgcttggctgccgcaggtatatatagcatcctgaagaagataggccgggacaaagtaccaagcagtggcagtaaaatgccaaggactgtaattgccttggatggtgggctctatgagcattacaagaagttcagcagctgcgtcgaagcaactcttacagacttgctcggcgaagaggcctcttcctccgtggttgccaaactggccaacgatggctctggcattggagctgctctccttgcagcctcacactcccagtatggcaagagtgactagtcttgataacgggcgtcgatcgaacttcgagtgtagctctcatttttatcttttttcccttcaaaacatccctaatattccggctctcctcggggaatttttcggcttcctttcttggctattctgtggatgcacttaaggctctgcagcgggatatagctagtatagagccaatcagtttggaggttatctaatggcataaggtttggacggcaggagcatagaaatggaagctgaacaatgccattcatgttctgcccagtttttcttctccttgtatggtgttgtaaaccaatcaaaacttttaacctttttgtgttggcaataaagaggaggc

SEQ ID NO: 670 - protein, 507 aa, Zea mays
  subsp. mays
MGKSVVVGAAVVACAAVGVAAVLVHRRRRRDAALLGSAEAERRRRAAAVIEEVERSLATPTALLRGIADAMVAEMERGLRGDIHAQLKMLISYVDNLPTGDEHGLFYALDLGGTNFRVLRVQLGGREKRVVKQQYEEVSIPPHLMVGTSIELFDFIAAALAKFVDTEGDDFHLPEGRQRELGFTFSFPVNQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSGKLPLSEYDKAMDFESLNPGEQIYEKMISGMYLGEIVRRILLKLAHDASLFGDVVPTKLEQPFILRTPDMSAMHHDSSHDLKTLGSKLKDIVGVADTSLEVRYITRHICDLVAERGARLAAAGIYSILKKIGRDKVPSSGSKMPRTVIALDGGLYEHYKKFSSCVEATLTDLLGEEASSSVVAKLANDGSGIGAALLAASHSQYGKSD

SEQ ID NO: 671 - DNA, 2008 bp, Zea mays; identical to SEQ ID NO: 669
  CDS (358)..(1671): subsp. mays

SEQ ID NO: 672 - protein, 437 aa, Zea mays
  subsp. mays
MVAEMERGLRGDIHAQLKMLISYVDNLPTGDEHGLFYALDLGGTNFRVLRVQLGGREKRVVKQQYEEVSIPPHLMVGTSIELFDFIAAALAKFVDTEGDDFHLPEGRQRELGFTFSFPVNQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSGKLPLSEYDKAMDFESLNPGEQIYEKMISGMYLGEIVRRILLKLAHDASLFGDVVPTKLEQPFILRTPDMSAMHHDSSHDLKTLGSKLKDIVGVADTSLEVRYITRHICDLVAERGARLAAAGIYSILKKIGRDKVPSSGSKMPRTVIALDGGLYEHYKKFSSCVEATLTDLLGEEASSSVVAKLANDGSGIGAALLAASHSQYGKSD

SEQ ID NO: 673 - DNA, 2008 bp, Zea mays; identical to SEQ ID NO: 669
  CDS (370)..(1671): subsp. mays

SEQ ID NO: 674 - protein, 433 aa, Zea mays
  subsp. mays
MERGLRGDIHAQLKMLISYVDNLPTGDEHGLFYALDLGGTNFRVLRVQLGGREKRVVKQQYEEVSIPPHLMVGTSIELFDFIAAALAKFVDTEGDDFHLPEGRQRELGFTFSFPVNQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSGKLPLSEYDKAMDFESLNPGEQIYEKMISGMYLGEIVRRILLKLAHDASLFGDVVPTKLEQPFILRTPDMSAMHHDSSHDLKTLGSKLKDIVGVADTSLEVRYITRHICDLVAERGARLAAAGIYSILKKIGRDKVPSSGSKMPRTVIALDGGLYEHYKKFSSCVEATLTDLLGEEASSSVVAKLANDGSGIGAALLAASHSQYGKSD

SEQ ID NO: 675 - DNA, 1807 bp, Zea mays
  CDS (211)..(1530): subsp. mays
  misc_feature (1668)..(1668): n is a, g, c or t
  misc_feature (1740)..(1740): n is a, g, c or t
  misc_feature (1756)..(1756): n is a, g, c or t
  misc_feature (1758)..(1758): n is a, g, c or t
atggtgaaggccgtggtggtgggcgcggcggtcgtggcgtgtgcggcggtcggggtggcggtggtgctggagcgccgccggcggaagcgagacgccgacctcctggggtccgcggaggcggagaggaggaggcgcgcggccgccgtcatcgaggaggtcgagagcagcctcgccacgcccacggcgctgctgcggggcatcgcggacgccatggtcgccgagatggagcgcggcctgcgcggggacatccacgcgcagctcaagatgctcattagctacgtcgacagcctccccaccggagatgaacatgggctgttttatgcactggatcttggagggaccaacttccgtgtgctgcgagtccagctaggaggaaaggagaaacgtgttgtcaaacaacagtatgaggaggtttccattccaccacatttgatggtcgggacttccatggaactatttgatttcattgctgctgcattggctaaatttgttggtactgaaggtgaagatttccaactcccagagggtaggcagagagaacttggtttcactttttccttcccggcgaaccaaacatcaatatcatcaggaacactcatcaagtggacaaagggcttttccatcaatggcacggttggtgaagatgttgtttctgagttgagcagggccatggagaggcagggactagatatgaaagttacggcattggtcaatgatacagttggcacattggctggtgggagatatatggataacgatgtagttgcagccgtaatattgggcactggtacaaatgcagcatatgtggagcatgcaaatgcaattcctaaatggactgggttactgcctaaatctggaaacatggtaattaatacagagtgggggagcttcaaatccaacaaacttcctctttcagaatatgacaaagccatggactttgaaagtttgaaccctggagagcagatatacgaaaaaatgatttctggtatgtatctcggagagattgttcgaagaattttactgaagttagcacatgaagcttctctatttggggatgttgttccacctaagctggagctgccatttatattgaggacgccagatatggcagccatgcatcatgactcctcacatgacctcaaaactcttggagctaaactgaaggacatagtcggggtcgcggacacttccctggaagtaaggtacatcactcgtcacatctgtgaccttgtcgcagagcgtgcagcacgcctggccgccgcaggcgtgtacagcatcctgaagaagataggccgggacaaagtaccaagcggtggcggtaaaatgccgaggaccgtagttgccttggacggtgggctctacgaacactacaagaagttcagcagttgcgtagaagcgactctcacagacttgctcggcgaggaggcttcttcctccgtggtcgccaagctggccaacgacggctctggcattggagctgcgcttctcgcagcctcacactcccagtatcagtatggcgcgagtgactagtagtcctgaaatgggcgcggatcgagattttgagtgtagctctcatttatcttttcttttttcccttttcaaaacatctttttggggatttttttcggcttccttttgttggctattccgtggatgcacttacggctntgcattgggatgtagctagtatagagccaatgagtttggaggttatctaatggcacaaggcaggagcatggnaatggaagcagagcantnccattcatgctgtgcccattcttttgttccccttgtatggtgtaatctg

SEQ ID NO: 676 - protein, 439 aa, Zea mays
  subsp. mays
MVAEMERGLRGDIHAQLKMLISYVDSLPTGDEHGLFYALDLGGTNFRVLRVQLGGKEKRVVKQQYEEVSIPPHLMVGTSMELFDFIAAALAKFVGTEGEDFQLPEGRQRELGFTFSFPANQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSNKLPLSEYDKAMDFESLNPGEQIYEKMISGMYLGEIVRRILLKLAHEASLFGDVVPPKLELPFILRTPDMAAMHHDSSHDLKTLGAKLKDIVGVADTSLEVRYITRHICDLVAERAARLAAAGVYSILKKIGRDKVPSGGGKMPRTVVALDGGLYEHYKKFSSCVEATLTDLLGEEASSSVVAKLANDGSGIGAALLAASHSQYQYGASD

SEQ ID NO: 677 - DNA, 1807 bp, Zea mays; identical to SEQ ID NO: 675
  CDS (223)..(1530): subsp. mays
  misc_feature (1668)..(1668): n is a, g, c or t
  misc_feature (1740)..(1740): n is a, g, c or t
  misc_feature (1756)..(1756): n is a, g, c or t
  misc_feature (1758)..(1758): n is a, g, c or t

SEQ ID NO: 678 - protein, 435 aa, Zea mays
  subsp. mays
MERGLRGDIHAQLKMLISYVDSLPTGDEHGLFYALDLGGTNFRVLRVQLGGKEKRVVKQQYEEVSIPPHLMVGTSMELFDFIAAALAKFVGTEGEDFQLPEGRQRELGFTFSFPANQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSNKLPLSEYDKAMDFESLNPGEQIYEKMISGMYLGEIVRRILLKLAHEASLFGDVVPPKLELPFILRTPDMAAMHHDSSHDLKTLGAKLKDIVGVADTSLEVRYITRHICDLVAERAARLAAAGVYSILKKIGRDKVPSGGGKMPRTVVALDGGLYEHYKKFSSCVEATLTDLLGEEASSSVVAKLANDGSGIGAALLAASHSQYQYGASD

SEQ ID NO: 679 - DNA, 2321 bp, Physcomitrella patens
  CDS (317)..(1858)
gctctctgagcctcacctccctcgctcccttgtcttgctctgcgatctctcgtcaagcttttttttcccccctttctttctttttctcccgtcctctgttgtgcttgcgccagccgatcgcctacacctagcagccgcggttggagtgctgtgtttttagctttttggagtcctcagatctggcagacagtttgatgtagggacgttggtgtaggtttattcagctgatcgattgagagtgcaaaaggcgaagctgtgtgcgtgtgcgtgtgcgtgtttgctcgtgagtgtttgggagtattgctaaagggtagcaatggcgatcgggaaggtactggggtgtgccgggtttcagcacagtgcagtgccaacgctccgtgaaccagtgcggctgagggcgcaatgcagacgccggggaaagaccgtgtctatgtcggttcagaagacgtcgaaaacggtacagcaggcggagaagatgtcgcaggagttccgtcagtcttcctctactcccctgcctcttttgcaccaggtagcggacgctctcgtgcaagaaatgtatgctggattggcgtcggaaggtggtagtgatcagctgaagatgcttccgacctatgtcgaaaacttgccttctgggagcgagaaggggctgttctatgccgtggatttgggcggcacaaacttccgtgttctgcgagtggaattgggaggcaaaacaggccaaattttgagccaagagttcaaggaagtggtaatccctccagagcttatggtgggcactggtaaggatcttttcgacttcattgctggtacactcgcatcatttgtcgacactgaagacgagtcaattaaagctcactttgttcaatcgggaaaaaccagggagtccggtttcgctttctccttccccgttcgacagacctcagtcaaatctggcattgtcatccactggacgaagggcttcaaagttgatgatgcggtgggcaaagacatcgtgaagcaatttcaggatgcaatcagcagaagtaaccatcagattatgatctcagccctggtaaacgacaccgttggcacgttggccggaggcagattcaacttcgacgaggagaccatgattggttgcattattggaacagggacaaacgcatgctatgtcgaacgtgccgatgctgtacataagtgggacgagccactgcccaaatcaggagaaatggttatcaatatggaatggggaaatttccgttcaccctacctgccacgaacatttgctgatgagactgttgacaaagacagcgtcaatccaggggaccagtggttcgagaaaatgatctctggaatgtacctcggcgagatcgtgcgccttgttctggctaggatggccaaagaagcggaactgtttggtggcaatgtccccgtgaagctcttggagcggctcaccctaggcaccccacatgtttccaaaatacatctggacaattcacctgacctcgacgtggttgccaaagttctcaaggacgtcttcgagatcgaaaccaccacacttgaggaaagaaagatagtacacgaggtgtgtgacatcatgggcgagcgaggtggaaggttggctgcagcaggtctctacggaatcctgaagaagatcggaagaaccggcaaatctcgaaacggatccaagaagaagaccgtgattgcaatggacggtggcctgttcgaacaccacgtccgttaccggtcatacatggaggaggcgctccaggagttgatgggttctgacgcagcgtacgaggtggcgttgagactacagaacgatggttctggaatcggtgccgctttgcttgccgcttcccactcacacttcaaataggataaaacgcacacaaagcttagggggatcatggcaggtgatgagcatcgcctgttttgcatgcctgtacaatattccgagtcctgatgatctgtctatcttctgagatgcacccatcgtctgtaccatttgtaccggcttatcgtaccgcaggaagacgccgttcttcaagtcgttgtctatctggtgaccaaaaccgcagagtttcaagctgagaggcctagtaggggtagtgtaggcagagtcaagttttattgtctctggtcagttacgtagaacagtttgcggttgagtctacccatctcatctagatctgcactgcacacctttcaataagctggtttcacttgaggttgccgtgcgcaagctagtatctggcacagagatgagaggttcattgctgcgcattctcttagcaatcctcacaatttccgaggtgattgtggggtgatggagctgggcg

SEQ ID NO: 680 - protein, 513 aa, Physcomitrella patens
MAIGKVLGCAGFQHSAVPTLREPVRLRAQCRRRGKTVSMSVQKTSKTVQQAEKMSQEFRQSSSTPLPLLHQVADALVQEMYAGLASEGGSDQLKMLPTYVENLPSGSEKGLFYAVDLGGTNFRVLRVELGGKTGQILSQEFKEVVIPPELMVGTGKDLFDFIAGTLASFVDTEDESIKAHFVQSGKTRESGFAFSFPVRQTSVKSGIVIHWTKGFKVDDAVGKDIVKQFQDAISRSNHQIMISALVNDTVGTLAGGRFNFDEETMIGCIIGTGTNACYVERADAVHKWDEPLPKSGEMVINMEWGNFRSPYLPRTFADETVDKDSVNPGDQWFEKMISGMYLGEIVRLVLARMAKEAELFGGNVPVKLLERLTLGTPHVSKIHLDNSPDLDVVAKVLKDVFEIETTTLEERKIVHEVCDIMGERGGRLAAAGLYGILKKIGRTGKSRNGSKKKTVIAMDGGLFEHHVRYRSYMEEALQELMGSDAAYEVALRLQNDGSGIGAALLAASHSHFK

SEQ ID NO: 681 - DNA, 1913 bp, Brassica napus
  CDS (272)..(1768)
gccggcaagaaactcgagtttgaatcggtttggagcatcgccggagatttctatcgtaatcaaggcagttagttttcacggtgtatagaagaaacagctgagcgagaaaggcggtcgagagagagaagaagaggaagaagataaaaaaaagtcgtcgatgacggtgaaacggagtcgttttggttcttctgaccggcggtactcactcctcaactctttattggagtaggtgcctagtaccgtcgagaggagagaagaaggaagtgttgtgatggggaaggttgcggttgcgtttgcggcggctgcggttttagtgtcttgctccgtggcggcggtgatggtggggaggaggattaagagtcgggcgaaatggagggccgtggtggagattttgaaggagttggaggaagcttgtgatactccggtggggaggctgaggcaagtggtggatgccatggcggtggagatgcacgctgggttggcttctgaaggtggctccaagcttaaaatgcttctcactttcgtccatcatttgcccaatgggacggagaaaggaacttattatgcacttcatcttggaggcacttactttaggattttgagggttcatctgggtggtgaaaggtcttatctagatgttcaagacgttgaacgacaccccataccttcacatttgatggatagcaccagcgaggttcttttcaactttctcgccttttccatggaaaggtttatcgaaaaagaaggaaaggaatctaattcacaaggtgtgaaaagggaactggcatttacgttttcgttccctgtcaagcattcttctatatcttccggagttctaatcaaatggaccaaaggttttgagattagtgaaatggttgggaaagatgtagctgaatgtctacaaggagcgatgaacagaagaggcctagatatccatgttgcagctcttgtgaatgatactgtgggagccctgtcacttggatattatcatgatccagatacagttgttgccgttgtatttggaacaggtagtaatgcatgttacttggaacgcactgatgccataatcaagtctcagggtctgcttaccacttctggaagcatggtagtcaatatggagtggggtaatttttggtcctcacacctgccaagaacttcatatgacattgacttggatgcagagagttcaaatccaaatgatatgggatttgaaaagatgatagcaggattgtatctgggtgacattgttagaagagtaatccgtcacatgtcacaagtctccgacatctttggacccacctcgtccatgttatctgagccttatgttctaagaacaaattcagtttcagccatgcatgaagatgacacacccgagttgcaacaagtagcaagaatcttgaaagacttgggggtatcagatgtaccattgaaggtgagaaaactcgtagtgaagatatgcgacgtggtgacacgaagagcagggaggctagcagcagcgggtattgcaggaatcttgaagaaggtaggtcgagatggtagcggaggaatcacgagcgggagaagcagaagcgaaatgcggatgcagaaaagaacagttgtcgcagtagaaggaggattgtacatgaactacaccatgtttagagaatacatggaagaagctttggtggagatattaggagaagaagtgagccaatacgtggtcgttaaagccatggaagatggttctagcattggctctgcccttctcgttgcctctttacagtcataaatcatcatcatcaattcatcatcgttgtttatataattggttatgtgcgtctgtgcagtgtgtgtgtgtgtgtatatatttattcaatatttgtttgttaattattattgttttttttttgttcaaatgttaaaaaaaaaaaaaa

SEQ ID NO: 682 - protein, 498 aa, Brassica napus
MGKVAVAFAAAAVLVSCSVAAVMVGRRIKSRAKWRAVVEILKELEEACDTPVGRLRQVVDAMAVEMHAGLASEGGSKLKMLLTFVHHLPNGTEKGTYYALHLGGTYFRILRVHLGGERSYLDVQDVERHPIPSHLMDSTSEVLFNFLAFSMERFIEKEGKESNSQGVKRELAFTFSFPVKHSSISSGVLIKWTKGFEISEMVGKDVAECLQGAMNRRGLDIHVAALVNDTVGALSLGYYHDPDTVVAVVFGTGSNACYLERTDAIIKSQGLLTTSGSMVVNMEWGNFWSSHLPRTSYDIDLDAESSNPNDMGFEKMIAGLYLGDIVRRVIRHMSQVSDIFGPTSSMLSEPYVLRTNSVSAMHEDDTPELQQVARILKDLGVSDVPLKVRKLVVKICDVVTRRAGRLAAAGIAGILKKVGRDGSGGITSGRSRSEMRMQKRTVVAVEGGLYMNYTMFREYMEEALVEILGEEVSQYVVVKAMEDGSSIGSALLVASLQS

SEQ ID NO: 683 - DNA, 1509 bp, Arabidopsis thaliana
  CDS (1)..(1509)
atgggtaaagtggcagttgcaacgacggtagtgtgttcggtggcggtatgtgcggcggcggcgttgatagtacggaggagaatgaaaagcgcagggaaatgggcaagagtgatagagatattgaaagcctttgaagaagattgtgcaacgccaattgccaaattgagacaagtggctgatgctatgactgttgagatgcatgctggtcttgcttctgaaggtggcagcaagcttaagatgcttattagctacgttgataatcttccttctggggatgagactggttttttctatgcgttggatctaggcggaacaaacttccgtgttatgcgtgtgcttcttggtgggaagcacgaccgtgttgttaaacgagaattcaaagaagaatctattcctcctcatttgatgaccgggaagtcacatgaattattcgattttatcgttgatgttcttgccaagtttgtcgctacagaaggcgaggactttcatctcccacctggtagacaacgggaactaggttttactttctcatttccggttaagcagctatctttatcctctggcactctcatcaactggacgaagggcttttccattgacgatacagttgataaagatgttgttggagaacttgttaaagctatggaaagagttgggctggacatgcttgtcgcagcgcttgttaatgataccattggaacacttgcgggtggtagatacactagcccggatgtcgttgtcgcagttattttgggcaccggcacaaatgcagcctatgtcgaacgtgcacatgcaattcccaaatggcatggtttgctacccaaatcaggagaaatggtgatcaacatggaatggggaaacttcaggtcatcacatcttccattgacagagtacgaccactctctagatgtcgatagtttgaatcctggtgaacagattcttgagaaaatcatttccggaatgtatctgggagaaatcttgcgtagagttcttctgaagatggctgaagaagctgccttctttggcgatatcgtcccacctaagctgaaaataccattcatcataaggaccccgaacatgtctgctatgcacagtgatacttccccggatttgaaggttgtaggaagcaagttaaaagacatattggaggtccagactagttctctgaagatgaggaaagttgtgatcagcctatgtaacatcattgcaagccgaggagctcgtttatctgctgcggggatctatggaatcctcaagaaaataggaagagacgcaacaaaagatggagaagctcagaaatctgtgatagcgatggacggtgggctattcgagcattacactcagttcagtgagtcgatgaagagttcattgaaagagttgcttggagatgaagtttcagagagtgttgaagtgatactgtcgaatgatggttcaggtgttggagctgcattacttgctgcttctcactctcagtatctcgaacttgaagatgactctgaaacaagttaa

SEQ ID NO: 684 - protein, 502 aa, Arabidopsis thaliana
MGKVAVATTVVCSVAVCAAAALIVRRRMKSAGKWARVIEILKAFEEDCATPIAKLRQVADAMTVEMHAGLASEGGSKLKMLISYVDNLPSGDETGFFYALDLGGTNFRVMRVLLGGKHDRVVKREFKEESIPPHLMTGKSHELFDFIVDVLAKFVATEGEDFHLPPGRQRELGFTFSFPVKQLSLSSGTLINWTKGFSIDDTVDKDVVGELVKAMERVGLDMLVAALVNDTIGTLAGGRYTSPDVVVAVILGTGTNAAYVERAHAIPKWHGLLPKSGEMVINMEWGNFRSSHLPLTEYDHSLDVDSLNPGEQILEKIISGMYLGEILRRVLLKMAEEAAFFGDIVPPKLKIPFIIRTPNMSAMHSDTSPDLKVVGSKLKDILEVQTSSLKMRKVVISLCNIIASRGARLSAAGIYGILKKIGRDATKDGEAQKSVIAMDGGLFEHYTQFSESMKSSLKELLGDEVSESVEVILSNDGSGVGAALLAASHSQYLELEDDSETS

SEQ ID NO: 685 - DNA, 1497 bp, Arabidopsis thaliana
  CDS (1)..(1497)
atggggaaagtggcggttgcgtttgcggcggttgctgttgttgcggcttgttctgttgccgcggtgatggttgggaggaggatgaagagtcggaggaaatggaggactgttgttgagattttgaaagagttggaggatgattgtgatactccggttgggaggttgaggcaagtggttgatgctatggccgtggagatgcacgctggtttggcttctgaaggtggctctaagcttaaaatgctcctcactttcgtcgatgatttgcccactgggagggagaaaggtacttattatgcacttcaccttggaggcacttattttaggattttaagggttcttctgggtgatcaaaggtcttatctagatgttcaagatgttgaacgacacccaataccttcacatttgatgaatagcaccagcgaggttcttttcaactttctcgccttttccttggaaaggtttattgaaaaggaggaaaacgggtccgattcacaaggtgttagaagggaacttgcatttacgttctcattccctgtcaagcatacttctatttcttcaggagttctaattaaatggaccaaaggttttgagattagtgaaatggttgggcaagatatagctgaatgtctacaaggagctctgaacagaagaggcctagatatgcatgttgcggctcttgtgaatgatactgttggagccttgtcgcttggatattatcacgatccagatacggttgttgcggttgtatttggaacaggtagtaatgcatgttacttggaaagaaccgatgccataatcaagtgtcagggtctgcttacaacttctggaagcatggtggtaaatatggagtggggaaatttttggtcctctcatttgcctagaacttcgtatgacattgacttggatgcagagagttcaaatgcaaatgatatgggatttgagaagatgatatcaggaatgtatctgggtgacattgttcgtagagtaattctccgcatgtcagaagattctgatatctttggacccatctcgcccgtgttatctgagccttacgttctaagaacaaattcagtctcagccatacatgaagatgacacacctgagttacaagaagtagcaagaatcttgaaagacataggggtatcagatgtaccactgaaggtgagaaaactagtggtgaaaatatgcgatgtggttacacgaagagcagggaggcttgcagcagcaggaatagcaggaatcttgaagaagataggccgagatggaagcgggggaatcacgagcgggagaagcagaagtgaaatccaaatgcagaaaagaacagttgttgcggtagaaggaggtttgtacatgaattacaccatgtttagggaatacatggaagaagctctcgtagagatactaggagaagaagtgagtcaatacgtggtggttaaagccatggaagatggttctagcattggctctgctctcctcgttgcctctttacagtcatga

SEQ ID NO: 686 - protein, 498 aa, Arabidopsis thaliana
MGKVAVAFAAVAVVAACSVAAVMVGRRMKSRRKWRTVVEILKELEDDCDTPVGRLRQVVDAMAVEMHAGLASEGGSKLKMLLTFVDDLPTGREKGTYYALHLGGTYFRILRVLLGDQRSYLDVQDVERHPIPSHLMNSTSEVLFNFLAFSLERFIEKEENGSDSQGVRRELAFTFSFPVKHTSISSGVLIKWTKGFEISEMVGQDIAECLQGALNRRGLDMHVAALVNDTVGALSLGYYHDPDTVVAVVFGTGSNACYLERTDAIIKCQGLLTTSGSMVVNMEWGNFWSSHLPRTSYDIDLDAESSNANDMGFEKMISGMYLGDIVRRVILRMSEDSDIFGPISPVLSEPYVLRTNSVSAIHEDDTPELQEVARILKDIGVSDVPLKVRKLVVKICDVVTRRAGRLAAAGIAGILKKIGRDGSGGITSGRSRSEIQMQKRTVVAVEGGLYMNYTMFREYMEEALVEILGEEVSQYVVVKAMEDGSSIGSALLVASLQS

SEQ ID NO: 687 - DNA, 1509 bp, Arabidopsis thaliana
  CDS (1)..(1509)
atggggaaggttttggtgatgttgacggcagctgcggctgtggtggcttgttcagtggcgactgtgatggtgagaaggaggatgaaagggaggaggaaatggaggagggtggtgggtttacttaaggatttggaggaagcttgtgagacgcctttaggaaggttgaggcagatggttgatgccatagctgtggagatgcaagctggtttggtttctgaaggagggtcaaagcttaaaatgttgctcacttttgttgatgatcttcccaatgggagcgagacaggaacctattatgcacttcatcttggaggctcctactttaggataataaaggttcatctaggtggtcaaagatcatctcttgaagttcaagatgttgaacgacattccataccaacatctttgatgaatagcactagcgaggttctcttcgactttctcgcatcatccttgcagaggtttattgaaaaagaagggaacgatttcagtttgtcacaacctttaaaaagggaacttgcgtttactttttctttcccagtcaagcagacatccatctcatcaggagttctaattaaatggaccaaaggttttgcaattagtgaaatggctggggaagacattgctgaatgtctacaaggagcgttgaacaagagagggctagatattcgcgttgcagctcttgtgaatgatactgttggggctttatcctttggacattttcatgacccagacacaattgctgctgttgtctttggaacaggtagtaatgcatgttaccttgaacgaactgatgccataatcaagtgtcaaaatccacgcacgacttctggaagcatggtggtcaatatggagtggggaaacttttggtcatctcgtctgccaagaacttcatatgaccttgagttggatgcagagagtatgaattcaaatgacatgggctttgagaagatgataggagggatgtatctgggcgacattgtccgcagagtaattcttcgaatgtcacaagagtccgacatctttggacctatctcatccattttatccacgcctttcgttctgagaacaaattctgtctcagcaatgcatgaagatgacacatccgagttacaagaagtagcacgaatcttgaaagatttaggggtgtcagaggtaccaatgaaggtgaggaaacttgtagtgaagatctgcgatgtagtgacacgcagagcagctaggctagcagcagcaggaattgcaggaatcttgaagaaggtagggagagatgggagcggaggaggaaggagaagcgataagcagataatgagaagaacagtggtggcagttgaaggaggtctgtatttgaactacaggatgttcagagaatatatggacgaagctctgagagatatactgggagaagatgtggctcaacacgtagtggtgaaggccatggaagatggttccagcattggctctgcattgttgctggcttcgtcacaaagtgttcaaacaataccatccgtatga

SEQ ID NO: 688 - protein, 502 aa, Arabidopsis thaliana
MGKVLVMLTAAAAVVACSVATVMVRRRMKGRRKWRRVVGLLKDLEEACETPLGRLRQMVDAIAVEMQAGLVSEGGSKLKMLLTFVDDLPNGSETGTYYALHLGGSYFRIIKVHLGGQRSSLEVQDVERHSIPTSLMNSTSEVLFDFLASSLQRFIEKEGNDFSLSQPLKRELAFTFSFPVKQTSISSGVLIKWTKGFAISEMAGEDIAECLQGALNKRGLDIRVAALVNDTVGALSFGHFHDPDTIAAVVFGTGSNACYLERTDAIIKCQNPRTTSGSMVVNMEWGNFWSSRLPRTSYDLELDAESMNSNDMGFEKMIGGMYLGDIVRRVILRMSQESDIFGPISSILSTPFVLRTNSVSAMHEDDTSELQEVARILKDLGVSEVPMKVRKLVVKICDVVTRRAARLAAAGIAGILKKVGRDGSGGGRRSDKQIMRRTVVAVEGGLYLNYRMFREYMDEALRDILGEDVAQHVVVKAMEDGSSIGSALLLASSQSVQTIPSV

SEQ ID NO: 689 - DNA, 1800 bp, Oryza sativa
  CDS (1)..(1800): Japonica cultivar group
atggagaggtgccagcgccgccgctggatcggcccagccatcaacgtgggccgtgagcccccctcgtcgacggcccatctaaggcccgcaccgcgaaaagcccaacgcacggcgaaggcgacggcggtggcgaccggcgaccccgactccggccaacttctccattcacctccatgccaatgtgacgcgagtaaatccatccaatccaatccaatccacgatccaatttggttgctggattctcttctgttcttggatagatatccatccgatccgaccatggacaatgtttcctccccctgttgctacgcagtgtgcagttaccgaaaagctaaggaacagaacaagaagagcacgacgcttatccctttccgctgccgccgtatcgatcgcttttcgattcgcctgtcggggaccgggatcatggcggcggtggaggcggagaaggtggtggcggagctgcgggagaggtgcgcgacgccggcgtcgctgctgcgggatgtggcggcggcgatggccggcgagatgggcgccggcctggagaaggagggtgggagcagggtcaagatgctgctctcctacgtcgacaagctccccactgggagagaggatggattgttctatggattggacctaggaggaacaaacttccgggtgctcaaggttcatcttggtggcagcaagaagcatgtcgtcaactctgaatccagggaagtcagcatcccaccacacctgatgtcagggacctcccaggaattgtttggtttcattgctggggaattaggcaagtttgttgctgaagaggaggagggtactgacatgccaaacggcaagaagaaagagctaggattcaccttctcttttcctgtgaggcaacgatctgtggcatcgggtacccttgtcaagtggacaaaggcgttttccattgatgatgcagtaggtgaagatgtggtggctgaactacaaacggctatggtgaaacaaggtctggacatgcatgtagctgcattgattaatgatgctgttggaacattggctggagcaagatactacgatgaagatgttgtcgcaggtgtgatatttggtactggcacaaatgctgcatatgttgagaaggcaaatgctataccaaaatgggaaggggagttgcccaattcaggggatatggtcatcaatatggaatggggtaatttctattcatcgcatcttccagttactgaatacgatgaagcattagacaaggaaagcttaaaccctggagagcagatatatgagaagttaacatcaggaatgtatttaggtgaaatcgtaagaagagtgctgcttaaactgtccttgcagtctggaattttcggttctatagataactccaagctcaaaacttgtttccatctgcggactccgcacatttctgcaatgcaccatgatgaaacacctgacctaaagatagtggctgaaaaattgcatcaaatcctgcagattacacatacatccttagagataaggaaaatggttgtcgaaatatgcgatatcgtggcaaggagggcagctcggctggctgctgctggtgttgcagggatcctcatgaagcttggaagaaatggcggcatcaacaatcagcgctcggtcatcgccattgatggaggtttgttcgaacactacaccaaattcagggaatgtttggagagcacgttgggtgagttgctgggagaggaggcttccaagtcggtagccgtcaagcacgcgaacgacgggtcagggataggggctgcccttattgcagcctctcaatctcgatga

SEQ ID NO: 690 - protein, 599 aa, Oryza sativa
  Japonica cultivar group
MERCQRRRWIGPAINVGREPPSSTAHLRPAPRKAQRTAKATAVATGDPDSGQLLHSPPCQCDASKSIQSNPIHDPIWLLDSLLFLDRYPSDPTMDNVSSPCCYAVCSYRKAKEQNKKSTTLIPFRCRRIDRFSIRLSGTGIMAAVEAEKVVAELRERCATPASLLRDVAAAMAGEMGAGLEKEGGSRVKMLLSYVDKLPTGREDGLFYGLDLGGTNFRVLKVHLGGSKKHVVNSESREVSIPPHLMSGTSQELFGFIAGELGKFVAEEEEGTDMPNGKKKELGFTFSFPVRQRSVASGTLVKWTKAFSIDDAVGEDVVAELQTAMVKQGLDMHVAALINDAVGTLAGARYYDEDVVAGVIFGTGTNAAYVEKANAIPKWEGELPNSGDMVINMEWGNFYSSHLPVTEYDEALDKESLNPGEQIYEKLTSGMYLGEIVRRVLLKLSLQSGIFGSIDNSKLKTCFHLRTPHISAMHHDETPDLKIVAEKLHQILQITHTSLEIRKMVVEICDIVARRAARLAAAGVAGILMKLGRNGGINNQRSVIAIDGGLFEHYTKFRECLESTLGELLGEEASKSVAVKHANDGSGIGAALIAASQSR

SEQ ID NO: 691 - DNA, 1527 bp, Oryza sativa
  CDS (1)..(1527): Japonica cultivar group
atggggagggtggggctcggcgtggcggtggggtgcgcggcggtgacctgcgcgatcgccgcggcgctcgtggcgcgcagggcgtcggcgcgggcgcggtggcggcgggcggtggcgctgctgcgggagttcgaggaggggtgtgccacgccgcccgcgaggctgcgccaggtcgtggacgccatggtcgtcgagatgcacgccggcctcgcgtccgatggcggcagcaagctcaagatgctgctcaccttcgtcgacgcgctccccagcgggagtgaagaaggtgtatattattctattgatcttggaggaacaaacttcagagtcttgagggtacaagttggtgcgggatctgtgatcgtcaaccaaaaggttgaacagcaacccatccctgaggaactgaccaaaggcactactgagggtttattcaactttgttgccctggcactaaagaattttcttgaaggagaagatgaccaagatggaaaaatggcacttggttttacattttctttccctgttagacaaatttcagtgtcttcagggtcattaattaggtggacaaaaggattttccatcagagacacggttggcagagatgttgctcagtgcttaaatgaagcgcttgccaattgtgggctaaatgtgcgggtcactgcattggtgaatgatacagtggggacattagctctagggcattactatgatgaagacacagtggctgctgtgataattgggtctggcaccaacgcttgctacattgaacgcactgatgcaattatcaagtgccagggtcttctaacgaactctggaggcatggtagtaaacatggagtgggggaatttctggtcatcacatttgccaaggacgccatatgacatcttgctggatgatgaaacacacaatcgcaatgatcagggctttgagaaaatgatatcaggaatgtatcttggggaaattgcaagattggtatttcatagaatggcccaggaatcagatgtttttggtgatgctgctgatagtctatccaaccctttcattttgagcacaccgtttctggccgcaattcgcgaggacgattcaccagatctgagcgaagtcagaaggatacttcgagaacatctgaagttgtctgatgattctctcttccagattcccgatgctcctctgaaaactcgacggctggtcgtgaaagtctgcgacattgtgactcgcagagccgcccgtctagccgctgcaggcatcgtggggatactgaagaagctggggagggatgggagcggcgcggcgtcgagcgggagaggtagagggcagccgaggaggacggtggtggcgatcgagggcgggctgtaccagggttacccggtgttcagggagtacctggacgaggccctggtggagatcctgggggaggaggtggcgcggaacgtgacgctgagggtgacggaggatgggtcgggggtcggggctgccctcctcgccgccgtacattcgtcgaatagacagcaacaaggaggtcccatatag

SEQ ID NO: 692 - protein, 508 aa, Oryza sativa
  Japonica cultivar group
MGRVGLGVAVGCAAVTCAIAAALVARRASARARWRRAVALLREFEEGCATPPARLRQVVDAMVVEMHAGLASDGGSKLKMLLTFVDALPSGSEEGVYYSIDLGGTNFRVLRVQVGAGSVIVNQKVEQQPIPEELTKGTTEGLFNFVALALKNFLEGEDDQDGKMALGFTFSFPVRQISVSSGSLIRWTKGFSIRDTVGRDVAQCLNEALANCGLNVRVTALVNDTVGTLALGHYYDEDTVAAVIIGSGTNACYIERTDAIIKCQGLLTNSGGMVVNMEWGNFWSSHLPRTPYDILLDDETHNRNDQGFEKMISGMYLGEIARLVFHRMAQESDVFGDAADSLSNPFILSTPFLAAIREDDSPDLSEVRRILREHLKLSDDSLFQIPDAPLKTRRLVVKVCDIVTRRAARLAAAGIVGILKKLGRDGSGAASSGRGRGQPRRTVVAIEGGLYQGYPVFREYLDEALVEILGEEVARNVTLRVTEDGSGVGAALLAAVHSSNRQQQGGPI

SEQ ID NO: 693 - DNA, 1536 bp, Oryza sativa
  CDS (1)..(1536): Japonica cultivar group
atggaggggagggcggcggggtgggtgagggtggcggcggtggggtgggcggtggcggcgtgcgcggtggcggcggggatggtggcgaggcgaggggcggcgagggtgcggtggaacagggcggtggcggtggtgcgggacctggaggagcggtgcgccacgcccgcggagctgctgcagcgggtggtcaactcgctggccatcgagatgttcgccggcctcgcctccgacggcgggagcaaggtgcggatgctgctcacctgcgtcgacgcgctccccgacggtagttcacatgacatgaccaggagcgaggaaggcatcagttatgccattgatcttggaggaacaagctttagagtcctgaaagtagaacttggcgcagggtctacaatcatcaatcgaaaagttgaacatcagcctatccccgaaaatttgactaagggtacaagcgatgatttgttcaatttcattgcctcggcactgaagaattttattgaaagagagggtggggaggttgaggggagggcacttggttttacattttctttccctgtgagacagacttccatttcctcggggacattaattcgatggactaaagaattttcaattgaagaggctgtcgggaaagatgttgctcagtgcctaaatgaagcccttgctaggaatggactcaatatgaaggtcaatgtattggtgaacaatactgtggggacattagctctcgggcattattatgatgatgacacagtagctgctgtgattattggagctggcaccaatgcttgctatattgaacgcaacgatgcaattattaaatctttgggtcgcgttaccaattctgaacgaacggtagtaaatgtggaatggggtagttttcggcctccacaaatagaattgactccttatgatatatgcttcaacaacgaaacatggaattattatgaccagggttttgagaaaatgatctctggtgtgtatcttggggaaattgcaagattggtgttccaaaaaatggctgaagagtcagatatatttggtactgctgttgatggtctatcgacccctttcgtcttaagtacaccaaacttagctgctatccgcgaggatgattccccggacttgagagaagtcggcaagatacttgaggaacatcttaagctaccagatgttcccctcaagacccggaagcttgttgccagagtctccgacatcatcacccggagagctgcccgcctagcagcggctgcgattgtcgcgatactgcaaaagatcggctgcgatggaaccctttgtggttcaactcaggttcgaacaatgcgaggcgtgcgaagaagaacggtggtcgcgatcgagggcggcctcttcgaaggctactcggtcttcagagagtatctgaatgaagctctagttgagatccttggagaggagattgcagccactgttagtcttagggtgatggaggagggatctgggactggtgctgccctccttgcagctgcatattcatcggctaggcagaagaactccgagtag

SEQ ID NO: 694 - protein, 511 aa, Oryza sativa
  Japonica cultivar group
MEGRAAGWVRVAAVGWAVAACAVAAGMVARRGAARVRWNRAVAVVRDLEERCATPAELLQRVVNSLAIEMFAGLASDGGSKVRMLLTCVDALPDGSSHDMTRSEEGISYAIDLGGTSFRVLKVELGAGSTIINRKVEHQPIPENLTKGTSDDLFNFIASALKNFIEREGGEVEGRALGFTFSFPVRQTSISSGTLIRWTKEFSIEEAVGKDVAQCLNEALARNGLNMKVNVLVNNTVGTLALGHYYDDDTVAAVIIGAGTNACYIERNDAIIKSLGRVTNSERTVVNVEWGSFRPPQIELTPYDICFNNETWNYYDQGFEKMISGVYLGEIARLVFQKMAEESDIFGTAVDGLSTPFVLSTPNLAAIREDDSPDLREVGKILEEHLKLPDVPLKTRKLVARVSDIITRRAARLAAAAIVAILQKIGCDGTLCGSTQVRTMRGVRRRTVVAIEGGLFEGYSVFREYLNEALVEILGEEIAATVSLRVMEEGSGTGAALLAAAYSSARQKNSE

SEQ ID NO: 695 - DNA, 1491 bp, Solanum chacoense
  CDS (1)..(1491)
atgaagaaggcgacggtggctgcggtggtggtaggtacagcggcggcggtagctgtggcggcgctcatcatgcgccaccgcatgggtaaatcgagcaaatgggcacgtgccagggcaattctgaaggaattcgaggagaaatgtgccaccccagatggcaagctgaagcaagtggctgatgccatgacggtggagatgcacgccggactcgcctctgaaggcggcagcaagctcaagatgcttattagctatgtcgataatctccctactggcgatgaaggaggagtcttttatgcattggatcttggtggaacaaattttcgagtattgcgggtgcaattggggggaaaagatggtggcattatccatcaagaatttgcggaggcatcaattcctccaaatttgatggttggaacttcagaagcactttttgactatattgcggcagaacttgcaaaattcgtagctgaagaaggagaagagtttcatccacctcctggtaggcagagagaattaggcttcaccttctcgttcccaataatgcagacttcaatcaattctggaactcttatcaggtggacgaaaggtttctccattgatgacacggttggcaaagatgttgttgcagaactgacaaaagcaatgcaaaaacgagaaattgatatgagggtctcagcgcttgtgaatgatactgttggaacattggctggtggtagattcaccaataaggatgtatccattgctgtgatattaggtactgggaccaatgcagcatatgtggaacgggctcaggcaattcccaaatggcacggtcctctgcctaaatctggagaaatggtgatcaatatggaatggggtaactttaggtcctcccaccttcccttgacagagtacgatcatgctatggataccgatagtttaaatcctggtgaacagatatttgagaagatatgttctggcatgtacttgggagaaattttacgcagagttctacttagaatggctgaagaagctggcatttttggcgaggaagttcctccaaaactcaagaattcattcatattgaggacacctgaaatgtctgctatgcatcatgacacatcctctgatttgagagtggttggcgacaagttgaaggatatcttagagatatccaatacctccttgaagacaaggagattagttgttgagctgtgtaatattgttgcaacacgtggcgccagacttgcggcagctgggatcttgggcattatcaaaaagatgggaaaggatacacccagggaaagtggtccagaaaagattgtcgtagccatggatggcggattgtatgaacattatacagaatacagtaagtgcttggagaacactttggttgaattacttggaaaggaaatggccacaagtattgttttcaagcacgcgaatgatggttctggcattggcgctgcactccttgcggcctctaactccgtgtatgttgaagacaagtga

SEQ ID NO: 696 - protein, 496 aa, Solanum chacoense
MKKATVAAVVVGTAAAVAVAALIMRHRMGKSSKWARARAILKEFEEKCATPDGKLKQVADAMTVEMHAGLASEGGSKLKMLISYVDNLPTGDEGGVFYALDLGGTNFRVLRVQLGGKDGGIIHQEFAEASIPPNLMVGTSEALFDYIAAELAKFVAEEGEEFHPPPGRQRELGFTFSFPIMQTSINSGTLIRWTKGFSIDDTVGKDVVAELTKAMQKREIDMRVSALVNDTVGTLAGGRFTNKDVSIAVILGTGTNAAYVERAQAIPKWHGPLPKSGEMVINMEWGNFRSSHLPLTEYDHAMDTDSLNPGEQIFEKICSGMYLGEILRRVLLRMAEEAGIFGEEVPPKLKNSFILRTPEMSAMHHDTSSDLRVVGDKLKDILEISNTSLKTRRLVVELCNIVATRGARLAAAGILGIIKKMGKDTPRESGPEKIVVAMDGGLYEHYTEYSKCLENTLVELLGKEMATSIVFKHANDGSGIGAALLAASNSVYVEDK

SEQ ID NO: 697 - DNA, 1500 bp, Lycopersicon esculentum
  CDS (1)..(1500)
atgtcggtcaccgttagctcgccggccgtccgatccttccatgtttcacgatcacctcataaaacgatctctaggccacgtgtcattatatctgccgtccgatctactgacagcttaggagtagcaccaattttgacgaagttgcagaaagattgtgctactcctcttccagttttgcgccacgtggcggatgcaatggccgatgatatgagggccgggcttgccgtcgacggcggcagtgatctgaagatgatccttagttatgtcgacactctaccaactgggaatgagaaaggcttgttttatgcgttggaccttggtggtacaaatttccgggtgctaagggtgcagctaggtggtaaagaagagcgtgtagtcgccactgagtttgagcaagtctctataccccaagaactgatgtttgctacctccgaggagcttttcgatttcatagcttctgcgctaggaaaatttgcacaaaaggaaggtggtaattttgagttgcaacagggacggacaagggaaataggattcacgttttcttttccggtgaaacagacttcaataagaactggaatcctaatcaaatggacaaaaggttttgctgtctctggaactgcgggaaaagatgttgttgcttgtctgaatgaagccatggagaggcggggaatggatatgcaagtgtctgccctggtcaatgacactgtgggaacacttgccggagcaagatactgggatgatgatgccatggttgctgtcattcttgggactggaaccaatgcttgctatgtagaacgtgtggatgctattcctaagctggcaaaaaggatgtctaagtctccaataacgattgtgaataccgaatggggagctttctcaaatggccttcctttaactgagtttgatagagaaatggatgccgagagcattaaccctggtgagcagatttttgaaaagaccatctctggtatgtaccttggggaaattgtgagacgggtgctggtcaaaatggccaaggttgggggcttatttggtagcagctatgttccggagaagctagtcactccatttgtgctgaggacacctgatatatgtgccatgcagcaggatacatcaatagatcttgaagctgttgagtctgtcctctatgatgtagctggggtaaaatccgatctaagtgcaaggaaaacagtcgtggacatttgcgatactattgcaaaacgagggggtcgtctagctggtgcaggaattgttggtatattacagaaaatggaggaagattctaaaggtctcatctttggtaaaagaacagttgtagcaatggatggaggcttatatgagcactatcctcagtacagaggatacctccaagaagctgtcacagagctactaggctcggaaatttcgaaaaatgtagtgatagaacattcaaaagatggatctggtattggagctgcattattagctgctgcaaattcaaagtatgaacatgatgattaa

SEQ ID NO: 698 - protein, 499 aa, Lycopersicon esculentum
MSVTVSSPAVRSFHVSRSPHKTISRPRVIISAVRSTDSLGVAPILTKLQKDCATPLPVLRHVADAMADDMRAGLAVDGGSDLKMILSYVDTLPTGNEKGLFYALDLGGTNFRVLRVQLGGKEERVVATEFEQVSIPQELMFATSEELFDFIASALGKFAQKEGGNFELQQGRTREIGFTFSFPVKQTSIRTGILIKWTKGFAVSGTAGKDVVACLNEAMERRGMDMQVSALVNDTVGTLAGARYWDDDAMVAVILGTGTNACYVERVDAIPKLAKRMSKSPITIVNTEWGAFSNGLPLTEFDREMDAESINPGEQIFEKTISGMYLGEIVRRVLVKMAKVGGLFGSSYVPEKLVTPFVLRTPDICAMQQDTSIDLEAVESVLYDVAGVKSDLSARKTVVDICDTIAKRGGRLAGAGIVGILQKMEEDSKGLIFGKRTVVAMDGGLYEHYPQYRGYLQEAVTELLGSEISKNVVIEHSKDGSGIGAALLAAANSKYEHDD

SEQ ID NO: 699 - DNA, 1500 bp, Lycopersicon esculentum
  CDS (1)..(1500)
atgggaaaattggttgtaggtgcaacagttgtgtgtactgctgctgtagtatgtggggtgacagttttgttaatgaaacatagggtgaagaattctggggagtggggaaaagttgaagctttattgaaagattttgaggagaagtgtgcaactccagtggaaaaattaaagcaggtagctgatgctatgactgtagagatgcaagctggacttgcttctgaaggtgggagtaagctcaagatgcttattagctatgttgataaccttcctactggggatgaaaaaggtctgttttatgcattggatctaggcggcacaaactttcgagtgatgcgtgtacagttgggtgggaaagaaaagcgtatagttaaacatgaagttaaagaagtttcaattccacagaatgtgatgactggatcatcatctgaagtgttatttgattttattgccacggcacttgcagaatttgtagctacagaaggtgatgattttcatcttccacctggtagacaaagggagttaggctttaccttctctttccctgtgaaacaattgtcaattgcatcaggaactcttattaaatggacaaagggcttctccatagaagatttggttgggcaagatgtggttggagaattagcaaaagcaatggaaagggccggccttgacgtgcgtgtggctgcattagtaaatgatactgttggaacgttagcgggaggtcggtacaataatcctgatgtcattgctgcagtaattttgggtaccggaaccaatgcagcatatgttgaacgggctcatgcgattcccaaatggcatggtctgttgcctaaatccggagaaatggttatcaacatggaatggggtaatttccgctcatcacatcttccagtaacagaatatgaccaaaatcttgatattgagagtttaaaccccggtgagcagatttatgaaaagattatttccgggatgtatcttggagaaattttgcgtagagtattgtgtagaatggctgaagaagcttcattattcggtgattatgtcccatccaaactgaaagttcctttcgtattgaggactccggacatggctgctatgcatcacgacgagtctgctgatctcaaggttgttggaaataagctgaaggatatcttagaggtacctaattctaccttgaaaatgaggaaaatagttgtggagctgtgcgatattatcacctctcgtggagctcgtctttctgcagcaggaattgtgggcatcctcaagaaattgggaagagacacttttaaagacggagagaagcagaggtctgtcatagctgtggacggtgcattgtttgagcattacaccaagttcagaaattgcttgaaggaaactatgaaagagttactgggagatgctgcagatagcacagtcattgagctttctaatgatggttcaggcgttggagctgcacttttggctgcctcacattcccaatacacagatctcgaggaatcttga

SEQ ID NO: 700 - protein, 499 aa, Lycopersicon esculentum
MGKLVVGATVVCTAAVVCGVTVLLMKHRVKNSGEWGKVEALLKDFEEKCATPVEKLKQVADAMTVEMQAGLASEGGSKLKMLISYVDNLPTGDEKGLFYALDLGGTNFRVMRVQLGGKEKRIVKHEVKEVSIPQNVMTGSSSEVLFDFIATALAEFVATEGDDFHLPPGRQRELGFTFSFPVKQLSIASGTLIKWTKGFSIEDLVGQDVVGELAKAMERAGLDVRVAALVNDTVGTLAGGRYNNPDVIAAVILGTGTNAAYVERAHAIPKWHGLLPKSGEMVINMEWGNFRSSHLPVTEYDQNLDIESLNPGEQIYEKIISGMYLGEILRRVLCRMAEEASLFGDYVPSKLKVPFVLRTPDMAAMHHDESADLKVVGNKLKDILEVPNSTLKMRKIVVELCDIITSRGARLSAAGIVGILKKLGRDTFKDGEKQRSVIAVDGALFEHYTKFRNCLKETMKELLGDAADSTVIELSNDGSGVGAALLAASHSQYTDLEES

SEQ ID NO: 701 - DNA, 1443 bp, Arabidopsis thaliana
  CDS (1)..(1443)
atggtgagaaggaggatgaaagggaggaggaaatggaggagggtggtgggtttacttaaggatttggaggaagcttgtgagacgcctttaggaaggttgaggcagatggttgatgccatagctgtggagatgcaagctggtttggtttctgaaggagggtcaaagcttaaaatgttgctcacttttgttgatgatcttcccaatgggagcgagacaggaacctattatgcacttcatcttggaggctcctactttaggataataaaggttcatctaggtggtcaaagatcatctcttgaagttcaagatgttgaacgacattccataccaacatctttgatgaatagcactagcgaggttctcttcgactttctcgcatcatccttgcagaggtttattgaaaaagaagggaacgatttcagtttgtcacaacctttaaaaagggaacttgcgtttactttttctttcccagtcaagcagacatccatctcatcaggagttctaattaaatggaccaaaggttttgcaattagtgaaatggctggggaagacattgctgaatgtctacaaggagcgttgaacaagagagggctagatattcgcgttgcagctcttgtgaatgatactgttggggctttatcctttggacattttcatgacccagacacaattgctgctgttgtctttggaacaggtagtaatgcatgttaccttgaacgaactgatgccataatcaagtgtcaaaatccacgcacgacttctggaagcatggtggtcaatatggagtggggaaacttttggtcatctcgtctgccaagaacttcatatgaccttgagttggatgcagagagtatgaattcaaatgacatgggctttgagaagatgataggagggatgtatctgggcgacattgtccgcagagtaattcttcgaatgtcacaagagtccgacatctttggacctatctcatccattttatccacgcctttcgttctgagaacaaattctgtctcagcaatgcatgaagatgacacatccgagttacaagaagtagcacgaatcttgaaagatttaggggtgtcagaggtaccaatgaaggtgaggaaacttgtagtgaagatctgcgatgtagtgacacgcagagcagctaggctagcagcagcaggaattgcaggaatcttgaagaaggtagggagagatgggagcggaggaggaaggagaagcgataagcagataatgagaagaacagtggtggcagttgaaggaggtctgtatttgaactacaggatgttcagagaatatatggacgaagctctgagagatatactgggagaagatgtggctcaacacgtagtggtgaaggccatggaagatggttccagcattggctctgcattgttgctggcttcgtcacaaagtgttcaaacaataccatccatatga

SEQ ID NO: 702 - protein, 480 aa, Arabidopsis thaliana
MVRRRMKGRRKWRRVVGLLKDLEEACETPLGRLRQMVDAIAVEMQAGLVSEGGSKLKMLLTFVDDLPNGSETGTYYALHLGGSYFRIIKVHLGGQRSSLEVQDVERHSIPTSLMNSTSEVLFDFLASSLQRFIEKEGNDFSLSQPLKRELAFTFSFPVKQTSISSGVLIKWTKGFAISEMAGEDIAECLQGALNKRGLDIRVAALVNDTVGALSFGHFHDPDTIAAVVFGTGSNACYLERTDAIIKCQNPRTTSGSMVVNMEWGNFWSSRLPRTSYDLELDAESMNSNDMGFEKMIGGMYLGDIVRRVILRMSQESDIFGPISSILSTPFVLRTNSVSAMHEDDTSELQEVARILKDLGVSEVPMKVRKLVVKICDVVTRRAARLAAAGIAGILKKVGRDGSGGGRRSDKQIMRRTVVAVEGGLYLNYRMFREYMDEALRDILGEDVAQHVVVKAMEDGSSIGSALLLASSQSVQTIPSI

SEQ ID NO: 703 - DNA, 1494 bp, Nicotiana tabacum
  CDS (1)..(1494)
atgaagaaagtgacggtgggagccgccgtggttggtgcagctgcggtgtgtgcagtggcggcgttaatagtgaaccaccggatgcggaaatctagtaaatggggtcgtgctatggctattcttcgcgagtttgaggaaaagtgtaagactcaagatgcaaagcttaagcaagttgctgatgctatgactgttgagatgcacgccggacttgcttctgaaggcggcagcaagctcaagatgcttatcacctatgtcgataatctcccaactggtgatgaagctggcgtcttttatgcattggatcttggtggaacaaattttcgagtattgcgagtgcaattgggtggaaaagatggtggtattattcatcaagaatttgctgaggcatcaattcctccaagtttgatggttgggacttcagatgcactttttgattatattgcggctgagcttgcaaaatttgttgctgcggaagaggaaaaatttcatcaacctcctggtaagcagagagaactaggtttcaccttctcattcccagtaatgcagacttcaatcaactctgggactattatgcggtggacaaaaggcttctctattgatgatgcggttggccaagatgttgttggagaactcacaaaagctatgaaaagaaaaggtgtcgatatgcgggtctcagctctggtgaatgatactgttggaacattagctggtggtaaatatacgcaaaaggatgtagctgttgctgttatcttaggtacagggaccaatgcagcttatgtggagcgggtgcaggcaattccaaagtggcatggtcctgtgccaaaatctggtgaaatggttatcaatatggaatggggtaattttaggtcatcccatctgcccttgacggagtatgatcatgcattggataacgagagtttaaatcctggtgaacagatatttgagaagatgacttctggcatgtacttgggagaaattttacgcagagttctactcagggtgtctgaagaagctggcgtttttggtgatgaggtccctccaaagctcaaggattcatttgtgttaaggacacctgatatgtctgctatgcatcatgacacatcccctgatctgaaagtggttggtgaaaagctgaaggatattttagagatatctaatacctccttgaagacaaggaaattagtggttgagctgtgcaatatcgttgcaacacgtggggcaagacttgcagctgcaggggtactaggcatcttgaaaaagatgggaagagatacgcctaagcagggtggttcagaaaggacggttatagccatggatggcgggttgtatgagcactatacagaatatagaatgtgtttagagaactctttgaaggacttgctcggagaggaattggcaacgagcatcgtttttgtgcactccaatgatggttctggcattggtgctgctcttcttgctgcctctcattcaatgtaccttgaagatcaagcttag

SEQ ID NO: 704 - protein, 497 aa, Nicotiana tabacum
MKKVTVGAAVVGAAAVCAVAALIVNHRMRKSSKWGRAMAILREFEEKCKTQDAKLKQVADAMTVEMHAGLASEGGSKLKMLITYVDNLPTGDEAGVFYALDLGGTNFRVLRVQLGGKDGGIIHQEFAEASIPPSLMVGTSDALFDYIAAELAKFVAAEEEKFHQPPGKQRELGFTFSFPVMQTSINSGTIMRWTKGFSIDDAVGQDVVGELTKAMKRKGVDMRVSALVNDTVGTLAGGKYTQKDVAVAVILGTGTNAAYVERVQAIPKWHGPVPKSGEMVINMEWGNFRSSHLPLTEYDHALDNESLNPGEQIFEKMTSGMYLGEILRRVLLRVSEEAGVFGDEVPPKLKDSFVLRTPDMSAMHHDTSPDLKVVGEKLKDILEISNTSLKTRKLVVELCNIVATRGARLAAAGVLGILKKMGRDTPKQGGSERTVIAMDGGLYEHYTEYRMCLENSLKDLLGEELATSIVFVHSNDGSGIGAALLAASHSMYLEDQA

SEQ ID NO: 705 - DNA, 1491 bp, Nicotiana sylvestris
  CDS (1)..(1491)
atgaagaaggcgacggtgggtgctgtggtggtgggtacagcggtggcggtagctgtggcggcgctcatcatgcgccaccgcatgggtaaatcgagcaaatgggcacgtgccagggcaattctgaaggaattcgaggagaaatgtgccaccccagatggcaagctgaagcaagtggctgatgccatgacggtggagatgcacgccggactcgcctctgaaggcggcagcaagctcaagatgcttattagctatgtcgacaatctccctactggcgatgaaggaggagtcttttatgcattggatcttggtggaacaaattttcgagtattgcgggtgcaattggggggaaaagatggtggcattatccatcaagaatttgcagaggcatcaattcctccaaatttgatggttggaacttcagaagcactttttgactatattgcggcagaacttgcaaaattcgtagctgaagaaggagaagagtttcatccacctcctggtaggcagagagaattaggcttcaccttctcgttcccaataatgcagacttcaatcaattctggaactcttatcaggtggacgaaaggtttctccattgatgacacggttggcaaagatgttgttgcagaactgacaaaagcaatgcaaaaacgagaaattgatatgagggtctcagcgcttgtgaatgatactgttggaacattggctggtggtagattcaccaataaggatgtatccattgctgtgatattaggtactgggaccaatgcagcatatgtggaacgggctcaggcaattcccaaatggcacggtcctctgcctaaatctggagaaatggtgatcaacatggaatggggtaactttaggtcctcccaccttcccttgacagagtacgatcatgctatggataccgatagtttaaatcctggtgaacagatatttgagaagatatgttcgggcatgtacttgggagaaattttacgcagagttctacttagaatggctgaagaagctggcatttttggcgaggaagtccctccaaaactcaagaattcattcatattgaggacccctgaaatgtctgctatgcatcatgacacatcctctgatttgagagtggttggcgacaagttgaaggatatcttagagatatccaatacctccttgaagacaaggagattagttgttgagctgtgtaatattgttgcaacacgtggcgccagacttgcagcagctgggatcttgggcattatcaaaaagatgggaaaggatacacccagggaaagtgatccagaaaagattgtcgtagccatggatggcggattgtatgaacattatacagaatacagtaagtgcttggagaacactttggttgaattgcttggaaaggaaatggccacaagtattgttttcaagcacgcgaatgatggttctggcattggcgctgcactccttgcggcctctaactccgtgtatgttgaagacaagtga

SEQ ID NO: 706 - protein, 496 aa, Nicotiana sylvestris
MKKATVGAVVVGTAVAVAVAALIMRHRMGKSSKWARARAILKEFEEKCATPDGKLKQVADAMTVEMHAGLASEGGSKLKMLISYVDNLPTGDEGGVFYALDLGGTNFRVLRVQLGGKDGGIIHQEFAEASIPPNLMVGTSEALFDYIAAELAKFVAEEGEEFHPPPGRQRELGFTFSFPIMQTSINSGTLIRWTKGFSIDDTVGKDVVAELTKAMQKREIDMRVSALVNDTVGTLAGGRFTNKDVSIAVILGTGTNAAYVERAQAIPKWHGPLPKSGEMVINMEWGNFRSSHLPLTEYDHAMDTDSLNPGEQIFEKICSGMYLGEILRRVLLRMAEEAGIFGEEVPPKLKNSFILRTPEMSAMHHDTSSDLRVVGDKLKDILEISNTSLKTRRLVVELCNIVATRGARLAAAGILGIIKKMGKDTPRESDPEKIVVAMDGGLYEHYTEYSKCLENTLVELLGKEMATSIVFKHANDGSGIGAALLAASNSVYVEDK

SEQ ID NO: 707 - DNA, 1533 bp, Nicotiana tabacum
  CDS (1)..(1533)
atggggaggttagcggtggggatatcggcggggtttgcggtggcggcgtgtattgtggcggcagctatggtgggtaagagggtaaaaaggaggaggaagtggaagaagatggtgaaggttctagaagaactggaagagtcgtgtggtacacccgtgggtaggctaaagcaagtagtggatgctatggctgttgaaatgcacgctggacttgcctctgaaggcgggagtaaactcaagatgttgcttacttatgttgataagctcccaaatgggagggaaaagggaacatattatgctctgcaccttggtggtacgaattttagagtcttgagagtccacttaggaggccaaaggtctgctattcttggacaagatatagaacgacaacccattccgcaacatctaatgactagcacaagcgaggatctccttgatttcgttgcgtcatcattaaaggacttcattgaaaaggaaggtaatggcttggagcagccttcacccaggaggagagaacttggctttacattttcatttcctgtgaagcaaacttccgcctcatctggcattttgatcaaatggacaaagggattttcgattgaagacatgattggaagagatgtttctgaatgtctacaacaagcaattgctagaaaaggtcaagatgtgcgggtggcagcattgataaatgacactgtgggaactctagctcttggacattataatgatgaagacacagttgccgcggttgtaattgggaccggcactaacgcatgctatttggagcgggcagatgcaattattaagtgccaaggtcttttaacaacatcaggaggcatggtagtcaatatggaatggggaaacttttggtcatctcatttacctagaacctcatatgatattgacttggatgttgctagcccaaacccaaatgatcagggttttgagaaaatgatatcaggactgtatttgggagacattgtcaggagagtactccttagaatgtcacaggaatcagatgattttggacctgcatcatcaaaattagcagttcctttcgccttgaggacaccgttgatggctgctatgcacgaggatgattcacctgacttaagtgaagtagccaggattctgggagaagttctagagttacctgatgtcccagtgaaagttcggaagcttgtagtgaaggtatgtgatgtaattactcgaagggctgctagattagcagctgctggtatcgtgggaatattgaagaagataggtcgagatggaagtggaggcatagctggtggaaaattcaggagcgatagaccaagtcggatgagaagaacggttgtggctatcgagggtggtttatacacaagttacaccttattcagagaatacctgaatgaagcgatgaaggaaattttaggggaagaaatttcctcgaacgtcattcttagggtcatggaagatggatcagggattggagcagctcttcttgctgctgcaaattcagcctctgaagtggatagggtacagctgcactga

SEQ ID NO: 708 - protein, 510 aa, Nicotiana tabacum
MGRLAVGISAGFAVAACIVAAAMVGKRVKRRRKWKKMVKVLEELEESCGTPVGRLKQVVDAMAVEMHAGLASEGGSKLKMLLTYVDKLPNGREKGTYYALHLGGTNFRVLRVHLGGQRSAILGQDIERQPIPQHLMTSTSEDLLDFVASSLKDFIEKEGNGLEQPSPRRRELGFTFSFPVKQTSASSGILIKWTKGFSIEDMIGRDVSECLQQAIARKGQDVRVAALINDTVGTLALGHYNDEDTVAAVVIGTGTNACYLERADAIIKCQGLLTTSGGMVVNMEWGNFWSSHLPRTSYDIDLDVASPNPNDQGFEKMISGLYLGDIVRRVLLRMSQESDDFGPASSKLAVPFALRTPLMAAMHEDDSPDLSEVARILGEVLELPDVPVKVRKLVVKVCDVITRRAARLAAAGIVGILKKIGRDGSGGIAGGKFRSDRPSRMRRTVVAIEGGLYTSYTLFREYLNEAMKEILGEEISSNVILRVMEDGSGIGAALLAAANSASEVDRVQLH

SEQ ID NO: 709 - DNA, 1500 bp, Nicotiana tabacum
  CDS (1)..(1500)
atgggaaaattggttgtaggtgtatcagttgtgtgtactgctgctgtagtatgtggggtggcagttttgttaatgaagcgcaggatgaagaattctggggagtggggaaaagttgaagctttattgaaggattttgaggagaagtgtgcaactccaatggggaaacttaagcaggtagctgatgctatgactgtagagatgcatgctggacttgcttctgaaggtgggagtaagctcaagatgcttattagctatgttgataaccttcctactggggacgaagaaggtctgttttatgcattggatctaggcggcacaaactttcgtgtgatgcgtgtgcagttgggtgggaacgaaaagcgtatagttaaacatgaagttaaagaagtttcaattccacagaatgtgatggctggatcatcatctgaagtgttatttgattttattgccacggcacttgcagaatttgtagctacagaaggtgatgattttcatcttccacctggtagacaaagggaattaggctttaccttctctttccctgtgaaacaattgtcaattgcatcaggaactcttattaaatggacaaagggcttctccatagaagacgtggttggccaagatgtggtgggagaattagcaaaagcaatggaaagggccggccttgatgtgcgtgtgactgctttagtcaatgatactgttggaacgttagcagggggtcggtacaatgatcctgatgtcattgctgcagtaattttgggtactggaaccaatgcagcatatgttgaacgggctcatgcgattcccaaatggcatggtctgttgccgaaatccggagagatggttatcaacatggaatggggtaatttcctctcatcacatcttccagtaacagaatatgaccaaaatcttgatgttgagagtttaaaccccggggagcagatttatgaaaagatgatctccgggatgtatcttggagaaattttgcgtagagtattgtgtagaatggctaaagaagcttcattattcggtgattatgtcccatccaaactgaaaattcctttcatattgaggactccggatatggctgctatgcatcacgacgagtcggctgatctcaaggtggttggcaataaactgaaggatatcttagaggtacctaattctaccttgaaaatgaggaaaatagttgtggagctatgcgacatcatcacctctcgtggagctcgtctttctgcagcaggaatcgtgggcatcctcaagaaattgggaaaagacactttgaaggacggagagaaccagaggtctgtcatagctgtggacggtgcattgtttgagcgttacaccaagttcagaaattgcttggaggaaactatgaaagagttactgggagacactgcggacagcatagttattgagctttctaatgatggttcaggtgttggagctgcacttttggctgcctcgccttcccaatacacagatctcgaggaatcatga

SEQ ID NO: 710 - protein, 499 aa, Nicotiana tabacum
MGKLVVGVSVVCTAAVVCGVAVLLMKRRMKNSGEWGKVEALLKDFEEKCATPMGKLKQVADAMTVEMHAGLASEGGSKLKMLISYVDNLPTGDEEGLFYALDLGGTNFRVMRVQLGGNEKRIVKHEVKEVSIPQNVMAGSSSEVLFDFIATALAEFVATEGDDFHLPPGRQRELGFTFSFPVKQLSIASGTLIKWTKGFSIEDVVGQDVVGELAKAMERAGLDVRVTALVNDTVGTLAGGRYNDPDVIAAVILGTGTNAAYVERAHAIPKWHGLLPKSGEMVINMEWGNFLSSHLPVTEYDQNLDVESLNPGEQIYEKMISGMYLGEILRRVLCRMAKEASLFGDYVPSKLKIPFILRTPDMAAMHHDESADLKVVGNKLKDILEVPNSTLKMRKIVVELCDIITSRGARLSAAGIVGILKKLGKDTLKDGENQRSVIAVDGALFERYTKFRNCLEETMKELLGDTADSIVIELSNDGSGVGAALLAASPSQYTDLEES

SEQ ID NO: 711 - DNA, 1497 bp, Nicotiana tabacum
  CDS (1)..(1497)
atgggaaaagtggtggtgggtgcagcagtagtatgtacagctgcagtatgtgctgctgctgttttattaatgaggcacaaaatggaaaattcaggtaaatgggctaaagctatggatatattgaaagagtttgaggagaagtgtgaaactccaataggaaaacttaggcaagtggctgatgctatgactgtagagatgcatgctggacttgcttctgaaggtggtagcaaactcaagatgctcattagctatgttgataacctccccactggggacgaaaccggtctgttttatgcattagatctaggcggcacaaacttccgtgtgatgcgtgtgcagttgggcgggaaagaaaagcgtatagttaaacaagaagttaaagaagtttcaattccaaagaatgtgatggctggatcgtcatctgacgcgttatttgattttattgccacgacgcttgtaaaatttgttgctacagaaggcgacgattttcatcttccacccggtagacaaagggagttgggcttcaccttctctttcccagttaaacaactgtcaattgcatcaggaactcttattaaatggacaaagggcttctctatagatgatgcggttggccaagatgttgttagagagttaacaaaagcaatggaaagggtcggtcttgacgtgcgcgtggctgctttgatcaatgatactgttggaacattagcaggaggtcggtataacaaccctgatgtcattgctgcagtaatattgggtactggaaccaatgcagcatatgttgagcgggcaaatacgattcccaaatggcatggtctgctgcctaaatcaggagatatggttattaacatggaatggggtaatttccgctcatcacatcttccggtaacagaatacgaccaaagtcttgacgctgagagtttaaacccaggggagcagatttatgagaagatgatttccgggatgtatcttggagaaattttgcgcagagtcttgtgtagaatggctgaagaagcttcattttttgatgattatgtcccaccaaaactgaaaactccattcattttaaggactcaggacatgtctgctatgcatcacgacaagtctgctgatctcaaggtggttggcgacaagctgaaggatatcttagaggtacctaattctacctggaaaatgaggaaaataattgttgagctatgtgacattattacctctcgtggagctcgtctttctgcagcaggaatcgtgggtatcctcaagaaattgggaagagacactttgaaggatggagagaagcagaggtcagtaatagctgttgacggtgcattgtttgagcattacacaaagttcagaaattgcatggagggaactattaaagagttgttgggagacgccgcagaaaacatagtcgttaagctttcgtatgatggttctggtgttggagctgcactattggctgcttctcattcccagtacctcggactcaaggaatcttga

SEQ ID NO: 712 - protein, 498 aa, Nicotiana tabacum
MGKVVVGAAVVCTAAVCAAAVLLMRHKMENSGKWAKAMDILKEFEEKCETPIGKLRQVADAMTVEMHAGLASEGGSKLKMLISYVDNLPTGDETGLFYALDLGGTNFRVMRVQLGGKEKRIVKQEVKEVSIPKNVMAGSSSDALFDFIATTLVKFVATEGDDFHLPPGRQRELGFTFSFPVKQLSIASGTLIKWTKGFSIDDAVGQDVVRELTKAMERVGLDVRVAALINDTVGTLAGGRYNNPDVIAAVILGTGTNAAYVERANTIPKWHGLLPKSGDMVINMEWGNFRSSHLPVTEYDQSLDAESLNPGEQIYEKMISGMYLGEILRRVLCRMAEEASFFDDYVPPKLKTPFILRTQDMSAMHHDKSADLKVVGDKLKDILEVPNSTWKMRKIIVELCDIITSRGARLSAAGIVGILKKLGRDTLKDGEKQRSVIAVDGALFEHYTKFRNCMEGTIKELLGDAAENIVVKLSYDGSGVGAALLAASHSQYLGLKES

SEQ ID NO: 713 - DNA, 1497 bp, Nicotiana tabacum
  CDS (1)..(1497)
atgggaaaagtggtggtgggtgcagcagtagtatgtacagctgcagtatgtgctgctgctgttttattaatgaggcacaaaatgaaaaattcaggtaaatgggctaaagctatggatatattgaaagagtttgaggagaaatgtgaaactccaataggaaaattaaggcaagtggctgatgctatgactgtagagatgcatgctggtcttgcttctgaaggtggtagcaaactcaagatgcttattagctatgttgataacctccctactggggacgaaaccggtctgttttatgcattagatctaggcggcacaaacttccgtgtgatgcgagtgcagttgggcgggaaggaaaagcgtatagttaaacaagaagttaaagaagtttcaattccaaagaatgtgatggctggatcatcatctgatgcgttatttgattttattgccacggcgcttgtaaaatttgttgctacagaagacgacgattttcgtcttccacccggtagacaaagggagctgggcttcaccttctctttcccagttaaacaactgtcaattgcatcagggactcttattaaatggacaaagggcttctccatcgatgatacggttgggcaagatgttgttagagagttaacaaaagcaatggaaagggtcggtcttgacgtgcgcgtggctgctttggtcaatgatactgttggaacattagcaggaggtcggtataacaaccctgatgtcattgctgcagtaatattgggtactggaaccaatgcagcatatgttgagcgggcaaatacaattcccaaatggcatggcctgctgcctaaatcaggagatatggttattaacatggaatggggtaatttccgctcatcacatcttccggtaacagaatacgaccaaagtcttgacactgagagtttaaaccccggggagcagatttatgagaagatgatttccgggatgtatcttggagaaattttgcgcagagtcttgtgtagaatggctgaagaagcttcattttttgatgattatgtcccaccgaaactgaaaactccattcatattgaggactccggacatgtctgctatgcatcacgacaagtctgctgatctcaaggtggttggcgacaagctgaaggatatcttagaggtacctaattctacctggaaaatgaggaaaataattgtagagctatgtgacattattacctctcgtggagctcgtctttctgcagcaggaattgtgggcatcctcaagaaattgggaagagacactttgaaggatggagagaagcagaggtcagtaatagctgttgacggcgcattgtttgagcattacacaaagttcagaaattgcatggagggaactatcaaagagttgttgggagacgctgcggaaagcatagtcattgagctttcgaatgatggttcaggcattggagctgcactattggctgcttctcattcacaatatctcggactggaggaatcttga

SEQ ID NO: 714 - protein, 498 aa, Nicotiana tabacum
MGKVVVGAAVVCTAAVCAAAVLLMRHKMKNSGKWAKAMDILKEFEEKCETPIGKLRQVADAMTVEMHAGLASEGGSKLKMLISYVDNLPTGDETGLFYALDLGGTNFRVMRVQLGGKEKRIVKQEVKEVSIPKNVMAGSSSDALFDFIATALVKFVATEDDDFRLPPGRQRELGFTFSFPVKQLSIASGTLIKWTKGFSIDDTVGQDVVRELTKAMERVGLDVRVAALVNDTVGTLAGGRYNNPDVIAAVILGTGTNAAYVERANTIPKWHGLLPKSGDMVINMEWGNFRSSHLPVTEYDQSLDTESLNPGEQIYEKMISGMYLGEILRRVLCRMAEEASFFDDYVPPKLKTPFILRTPDMSAMHHDKSADLKVVGDKLKDILEVPNSTWKMRKIIVELCDIITSRGARLSAAGIVGILKKLGRDTLKDGEKQRSVIAVDGALFEHYTKFRNCMEGTIKELLGDAAESIVIELSNDGSGIGAALLAASHSQYLGLEES

SEQ ID NO: 715 - DNA, 1494 bp, Nicotiana tabacum
  CDS (1)..(1494)
atgaagaaggcgacggtgggagcggtggtggtgggggcggcggtgacggtagctgtgggggcactcatcgtccggcaccgaatgcggaaatcgagcaagtgggcacgtgcgagggcaattctgaaagaattcgaggagaagtgtgggaccccagatgccaagctaaagcaagtggcggatgccatgacggtggagatgcacgccggcctcgcctctgagggcggcagcaaactcaagatgcttatcagctatgtcgacaatctcccaactggcgatgaagaaggagtcttttatgcattggatcttggtggaacaaattttcgagtattgcgggtgcaattggggggaaaagatggtggtattgtccatcaagaatttacggaggcatcaattcctccaaatttgatggttgggacttcagaagcactttttgactatattgcggcagaacttgcaaaatttgttgctgaagaagaagaaaaatttcatcaacctcctggtaagcagagggaactcggtttcactttctcattcccaatcatgcagacttcaatcaattctggaactcttatcaggtggacgaaaggtttctccattgatgacacggttggacaagatgttgttgcagaactgacaaaagccatgcaaagaaaaggagttgatatgagggtgtcggcgctggtgaatgatactgttggaacattggctggtggtagattctccaataaggatgtatccattgctgtgatattaggtactgggaccaatgcagcatatgtggaacgggctcaggcaattcccaaatggcatggtcctctgcctaaatctggagaaatggttatcaacatggaatggggtaactttaggtcctcccatctccccttgacagagtacgaccatgcaatggatacagatagtttaaatcctggtgaacagatatttgagaagatatgctctggcatgtacttgggagaaattttacgcagagttctactcagaatgtctgaagaagctgccattttcggtgatgaggtccccccaaaactcaagaatcaattcatattgaggacacctgaaatgtctgctatgcatcatgacacatcctctgatttgagagtggttggcgacaagttgaaggatatcttagagatatccaatacctccttgaagacaagaagattagttgttgagctgtgcaacattgttgcaacacgtggcgcaaggcttgcagcggctggggtcttgggcattgtcaaaaagatgggcagggatacacccagggaaagtggtcaagaaaagatagtcgtagccatggatggtggattgtacgagcactatacagaatacagaaagtgcttggagaacactttagttgaattgcttggagaggaaatggcaacaagtattgttttcgagcacgcaaatgatggttctggcattggcgctgcacttcttgcggcctctaactccctatatgttgaagacaagtcttga

SEQ ID NO: 716 - protein, 497 aa, Nicotiana tabacum
MKKATVGAVVVGAAVTVAVGALIVRHRMRKSSKWARARAILKEFEEKCGTPDAKLKQVADAMTVEMHAGLASEGGSKLKMLISYVDNLPTGDEEGVFYALDLGGTNFRVLRVQLGGKDGGIVHQEFTEASIPPNLMVGTSEALFDYIAAELAKFVAEEEEKFHQPPGKQRELGFTFSFPIMQTSINSGTLIRWTKGFSIDDTVGQDVVAELTKAMQRKGVDMRVSALVNDTVGTLAGGRFSNKDVSIAVILGTGTNAAYVERAQAIPKWHGPLPKSGEMVINMEWGNFRSSHLPLTEYDHAMDTDSLNPGEQIFEKICSGMYLGEILRRVLLRMSEEAAIFGDEVPPKLKNQFILRTPEMSAMHHDTSSDLRVVGDKLKDILEISNTSLKTRRLVVELCNIVATRGARLAAAGVLGIVKKMGRDTPRESGQEKIVVAMDGGLYEHYTEYRKCLENTLVELLGEEMATSIVFEHANDGSGIGAALLAASNSLYVEDKS

SEQ ID NO: 717 - DNA, 1494 bp, Nicotiana tabacum
  CDS (1)..(1494)
atgaagaaagcgacggtgggagccgccgtggttggcgccgctacggtatgtgctgtggcggcattcatagtgaaccaccgtatgcgcaaatctagtaaatgggcacgtgctatggctattcttcgtgaatttgaggaaaagtgtgggacccctgatgctaagctcaagcaagtcgctgatgctatgaccgtcgagatgcacgctggacttgcctccgaaggtggtagcaagctcaagatgcttatcacttacgtcgataatctccccaccggtgatgaagccggcgtcttttatgcgttggatcttggtggaacaaattttcgagtattgcgagtgcaacttggtggaaaagatggtggtattgttcatcaagaatttgcggaggcatcaattcctccaaatttgatggtcgggacttcagaagcactttttgattatattgcggcagaacttgcaaaatttgtcgctgaggaagaggaaaagtttcaacaacctcctggtaagcagagagaactaggtttcaccttctcattcccggtaatgcagacttcaatcaactctgggactattatgaggtggacaaagggcttctccattgatgatgcggttggccaagatgttgttggagaactcacaaaagctatgaaaagaaaaggagttgatatgcgggtctcagctctggtgaatgatactgttgggacgttggctggtggtaaatatacacacaacgacgtagctgttgctgttatcttaggtacagggaccaatgcagcttatgtggaacgggtgcaggcgattccaaagtggcatggtccagtgccaaaatctggtgaaatggttatcaacatggaatggggtaattttaggtcatcccatcttcccttgacacagtatgatcacgcgttggatactaatagtttgaatcctggtgatcagatatttgagaagatgacttctggcatgtacttgggagaaattttacgcagagttctactcagggtggctgaagatgctggcatttttggtgatgaggtccctccaaagctcaagagtccatttgtattgaggacacctgatatgtctgctatgcatcatgacatatcctctgatctgagagtggttggtgacaagctgaaggatattctagagatatctaatacctccttgaagacaaggagattagtcgttgagctgtgcaacatcgttgcaacacgaggggcaaggcttgcagctgcaggtatattgggtatcttaaagaagatgggaagggatacacctaggcaaggtggtccagaaaagacggttgtagccatggatggcggattgtatgagcactatacagagtacagaacgtgcttagagaacacattgaaggaattgcttggagatgaattggcgacaagcattgttttcgagcactccaatgatggttctggcattggtgctgctcttcttgctgcctctaactcaatgtaccttgaagataagtcctag

SEQ ID NO: 718 - protein, 497 aa, Nicotiana tabacum
MKKATVGAAVVGAATVCAVAAFIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIVHQEFAEASIPPNLMVGTSEALFDYIAAELAKFVAEEEEKFQQPPGKQRELGFTFSFPVMQTSINSGTIMRWTKGFSIDDAVGQDVVGELTKAMKRKGVDMRVSALVNDTVGTLAGGKYTHNDVAVAVILGTGTNAAYVERVQAIPKWHGPVPKSGEMVINMEWGNFRSSHLPLTQYDHALDTNSLNPGDQIFEKMTSGMYLGEILRRVLLRVAEDAGIFGDEVPPKLKSPFVLRTPDMSAMHHDISSDLRVVGDKLKDILEISNTSLKTRRLVVELCNIVATRGARLAAAGILGILKKMGRDTPRQGGPEKTVVAMDGGLYEHYTEYRTCLENTLKELLGDELATSIVFEHSNDGSGIGAALLAASNSMYLEDKS

SEQ ID NO: 719 - DNA, 1497 bp, Lycopersicon esculentum
  CDS (1)..(1497)
atgaagaaagtgacggtgggagtcgccgtggttggtgcagctgcggtgtgtgcagtggcggtgttaatagtgaatcaccggatgcggaaatctagtaaatggggtcgtgctatggctattcttcgtgaatttgaagaaaagtgtaagactcaagatgcaaagcttaagcaagttgctgatgctatgactgttgagatgcacgccggacttgcttctgaaggcggcagtaagctcaagatgcttatcacttatgtggataatctacccactggtgatgaagctggcgtcttctatgcgttggatcttggtggaacaaattttcgagtattgcgagtgcaattgggtggaaaagatggtggtattattcatcaagaatttgctgaggcatcaattcctccaagtttgatggttgggacttcagatgaactttttgattatattgcggctgagcttgcaaaatttgttgctgcggaagaggaaaaatttcatcaacctcctggtaagcagagagaactaggtttcaccttctcattcccagtaatgcagacttcaatcaactccgggaatattatgcggtggacaaaaggcttctctattgatgatgcggttggtcaagatgttgttggagaactcacaaaagctatgaaaagaaaaggtgtcgatatgcgtgtctcagctctggtgaatgataccgttggaacgttagctggtggtaaatatacgcaaaaggatgtagctgttgctgttatcttaggtacagggaccaatgcagcttatgtggaacgggtgcaggcaattccaaagtggcatggtcctgtgccaaaatctggtgaaatggttatcaatatggaatggggtaattttaggtcatcccatctgccgttgacagagtatgatcatgcattggataatgagagtttaaatcctggtgaacagatatttgagaagatgacttctggcatgtacttgggagaaattttacgcagagttctacttagggtggctgaagaagctggcgtttttggtgatgaggtccctccaaagctcaaggaaccatttgtgttaaggacacctgatatgtctgctatgcatcatgacacatcctctgatctgaaagtggttggtgaaaagctgaaggatattttagagatatctaatacctccttgaagacgagaaaactagtggttgagctgtgcaatatcgttgccacacgtggggcaagacttgcagctgcaggtgtattgggcatcttgaaaaagatgggaagagatacgcctaagcagggtggttcagaaaggacggttatagccatggatggcgggttgtatgagcactatacagaatacaggatgtgtttagagaactctttgaaggacttgctgggagaggagttagcaacgagcatcgtttttgtgcactccaatgatggttctggcattggtgctgctcttcttgctgcctctcattcaatgtaccttgaagatcaagatgcttag

SEQ ID NO: 720 - protein, 498 aa, Lycopersicon esculentum
MKKVTVGVAVVGAAAVCAVAVLIVNHRMRKSSKWGRAMAILREFEEKCKTQDAKLKQVADAMTVEMHAGLASEGGSKLKMLITYVDNLPTGDEAGVFYALDLGGTNFRVLRVQLGGKDGGIIHQEFAEASIPPSLMVGTSDELFDYIAAELAKFVAAEEEKFHQPPGKQRELGFTFSFPVMQTSINSGNIMRWTKGFSIDDAVGQDVVGELTKAMKRKGVDMRVSALVNDTVGTLAGGKYTQKDVAVAVILGTGTNAAYVERVQAIPKWHGPVPKSGEMVINMEWGNFRSSHLPLTEYDHALDNESLNPGEQIFEKMTSGMYLGEILRRVLLRVAEEAGVFGDEVPPKLKEPFVLRTPDMSAMHHDTSSDLKVVGEKLKDILEISNTSLKTRKLVVELCNIVATRGARLAAAGVLGILKKMGRDTPKQGGSERTVIAMDGGLYEHYTEYRMCLENSLKDLLGEELATSIVFVHSNDGSGIGAALLAASHSMYLEDQDA

SEQ ID NO: 721 - DNA, 1530 bp, Zea mays
  CDS (1)..(1530)
atggtgaaggccgtggtggtgggcgcggcggtcgtggcgtgtgcggcggtcggggtggcggtggtgctggagcgccgccggcggaagcgagacgccgacctcctggggtccgcggaggcggagaggaggaggcgcgcggccgccgtcatcgaggaggtcgagagcagcctcgccacgcccacggcgctgctgcggggcatcgcggacgccatggtcgccgagatggagcgcggcctgcgcggggacatccacgcgcagctcaagatgctcattagctacgtcgacagcctccccaccggagatgaacatgggctgttttatgcactggatcttggagggaccaacttccgtgtgctgcgagtccagctaggaggaaaggagaaacgtgttgtcaaacaacagtatgaggaggtttccattccaccacatttgatggtcgggacttccatggaactatttgatttcattgctgctgcattggctaaatttgttggtactgaaggtgaagatttccaactcccagagggtaggcagagagaacttggtttcactttttccttcccggcgaaccaaacatcaatatcatcaggaacactcatcaagtggacaaagggcttttccatcaatggcacggttggtgaagatgttgtttctgagttgagcagggccatggagaggcagggactagatatgaaagttacggcattggtcaatgatacagttggcacattggctggtgggagatatatggataacgatgtagttgcagccgtaatattgggcactggtacaaatgcagcatatgtggagcatgcaaatgcaattcctaaatggactgggttactgcctaaatctggaaacatggtaattaatacagagtgggggagcttcaaatccaacaaacttcctctttcagaatatgacaaagccatggactttgaaagtttgaaccctggagagcagatatacgaaaaaatgatttctggtatgtatctcggagagattgttcgaagaattttactgaagttagcacatgaagcttctctatttggggatgttgttccacctaagctggagctgccatttatattgaggacgccagatatggcagccatgcatcatgactcctcacatgacctcaaaactcttggagctaaactgaaggacatagtcggggtcgcggacacttccctggaagtaaggtacatcactcgtcacatctgtgaccttgtcgcagagcgtgcagcacgcctggccgccgcaggcgtgtacagcatcctgaagaagataggccgggacaaagtaccaagcggtggcggtaaaatgccgaggaccgtagttgccttggacggtgggctctacgaacactacaagaagttcagcagttgcgtagaagcgactctcacagacttgctcggcgaggaggcttcttcctccgtggtcgccaagctggccaacgacggctctggcattggagctgcgcttctcgcagcctcacactcccagtatcagtatggcgcgagtgactag

SEQ ID NO: 722 - protein, 509 aa, Zea mays
MVKAVVVGAAVVACAAVGVAVVLERRRRKRDADLLGSAEAERRRRAAAVIEEVESSLATPTALLRGIADAMVAEMERGLRGDIHAQLKMLISYVDSLPTGDEHGLFYALDLGGTNFRVLRVQLGGKEKRVVKQQYEEVSIPPHLMVGTSMELFDFIAAALAKFVGTEGEDFQLPEGRQRELGFTFSFPANQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSNKLPLSEYDKAMDFESLNPGEQIYEKMISGMYLGEIVRRILLKLAHEASLFGDVVPPKLELPFILRTPDMAAMHHDSSHDLKTLGAKLKDIVGVADTSLEVRYITRHICDLVAERAARLAAAGVYSILKKIGRDKVPSGGGKMPRTVVALDGGLYEHYKKFSSCVEATLTDLLGEEASSSVVAKLANDGSGIGAALLAASHSQYQYGASD

SEQ ID NO: 723 - DNA, 1500 bp, Solanum tuberosum
  CDS (1)..(1500)
atgtcggtcaccgttagctcgccggccgtccgatccttccatgtttcacgatcacctcataaaacgatctataggccacgtgtcattatgtctgccgtccgatctagtgatagcttaggagtagcaccaattttgactaagttgcagaaagactgtgctactcctctcccagttttgcgccacgtggcggatgcaatggccgatgatatgcgggccgggcttgccgtcgatggcggcagtgatctgaagatgatccttagttatgtcgacactctaccaactgggaatgagaaaggcttgttttatgcgttggaccttggtggtacaaatttccgagtgctaagggtgcagctaggtggtaaagaagagcgtgtagtcgccactgagtttgagcaagtctctatacccccagaattgatgtttgctacctccgaggagctgttcgatttcatagcttctgcgctaggaaaatttgcacaaaaggaaggtggtaattttgagttgcaacagggacggacaagggaaataggattcacgttttcttttccagtgaaacagacttcaataagaactggaatcctaatcaaatggacaaaaggttttgctgtctctggaactgcaggaaaagatgttgttgcttgtttaaatgaagccatggagaggcggggaatggatatgcaagtgtctgccctggtcaatgacactgtgggaacacttgccggagcaagatactgggatgatgatgccatggttgctgtcattcttgggactggaaccaatgcttgctatgtagaacgtgtggatgctattcctaagctgacaaaaaggatgtccaagtctccaataacgattgtgaatactgaatggggagctttctcaaatggccttcctttaactgagtttgatagagaaatggatgccgagagcattaaccctggtgagcagatttttgaaaagaccatctccggtatgtaccttggggaaattgtgagacgggtgctggtcaaaatgtccaaggttgggggcttatttggtggcagctatgttccggaaaagttagtcactccatttgtgctgaggacacctgatatatgtgccatgcagcaggatacatcaagagatcttgaagctgttgaatctgtcctctatgatgtagctggggtaaaatccgatctaagtgcaaggaaaacagtcgtggacatttgcgatactattgcaaaacgagggggtcgtctggctggtgcaggaattgttgggattctacagaaaatggaggaggattctaaaggcctcatctttggtaaaagagcagttgtagcaatggatggaggcttatacgagcactatcctcagtacagaggatacctccaagaagctgtcacagagttactaggctcggaaatttcgaaaaatgtagtgatagaacattcaaaagatggttctggaattggagctgcattattagctgctgcaaactcaaagtatgaacatgattattaa

SEQ ID NO: 724 - protein, 499 aa, Solanum tuberosum
MSVTVSSPAVRSFHVSRSPHKTIYRPRVIMSAVRSSDSLGVAPILTKLQKDCATPLPVLRHVADAMADDMRAGLAVDGGSDLKMILSYVDTLPTGNEKGLFYALDLGGTNFRVLRVQLGGKEERVVATEFEQVSIPPELMFATSEELFDFIASALGKFAQKEGGNFELQQGRTREIGFTFSFPVKQTSIRTGILIKWTKGFAVSGTAGKDVVACLNEAMERRGMDMQVSALVNDTVGTLAGARYWDDDAMVAVILGTGTNACYVERVDAIPKLTKRMSKSPITIVNTEWGAFSNGLPLTEFDREMDAESINPGEQIFEKTISGMYLGEIVRRVLVKMSKVGGLFGGSYVPEKLVTPFVLRTPDICAMQQDTSRDLEAVESVLYDVAGVKSDLSARKTVVDICDTIAKRGGRLAGAGIVGILQKMEEDSKGLIFGKRAVVAMDGGLYEHYPQYRGYLQEAVTELLGSEISKNVVIEHSKDGSGIGAALLAAANSKYEHDY

SEQ ID NO: 725 - DNA, 1500 bp, Brassica oleracea
  CDS (1)..(1500)
atgggtaaagtggctgttggtgcgacggtcgtgtgcgctgcggcggtttgcgcggcgtctgtgtacatcgtgcggcggcggatgcaaagctccgggaaatgggcgcgtgtgatagagatcctgagggttctcgaggaggattgcgcgacgccaatcgggaaactgagacaagtggcggatgcgatgacggttgagatgcacgcgggtctcgcttccgaaggtggaagcaagcttaagatgcttatcagctacgtcgataatcttccttctggggaagaacatggtttcttttatgcgctggacctaggaggaacgaacttccgtgtgatgcgtgtgcttcttggtggcaaacaaggccgtgttgtcaaacaagaagccaaagaagtctctattcctcctcatttgatgaccagcggttcagatgagctgttcaattttatcgctgaagcgcttgcaaatttcgtggctacagaaggagaggactttcatctcccagagggtagacaaagggagctaggtttcactttctcgtttccggttaagcagacatctttgtcttctggcactctcatcaagtggaccaaaggcttctccatcgaagatacagttggacaagatgtggttggtgcgcttgttaaagctatggaaagagttgggcttgacatgaatgtcacagcccttgttaatgataccgttggaacacttgctggtggtagatactataaccctgatgttgtcgccgctgttattctaggcactggcacaaacgcagcttatgttgaacgtgcacatgccattcccaaatggcacggcttacttcccaaatctggagaaatggtgatcaacatggagtggggaaacttcaggtcatcacatcttccattgacggagtacgaccacttgctggatttcgatagtctgaatcctggtgaacagattcttgagaaaatcatttctggtatgtatttgggagagatcttgcgtagagtccttctgaaaatggctgacgaggctgctttctttggcgactctgtcccacctaagctgagaataccattcataataaggacaccaaacatgtctgctatgcacagcgacacttctccggatttgaaggttgttggaagcaagttaaaggacatattggaggtccctaccacttctctgaagatgagaaaagttgtggtcagtctgtgtgacatcatagcttgccgcggagctcgtctatcagctgcagggatctacggaatcctcaagaaactaggaagagacgcaccgaaagacggagagacgcagaaatctgtgatagccatggacggtggactgtttgagcactacactcagttcagcgagtgtatggagagctcgttgaaagagttgcttggagatgaagcatcagacagcgtggaggtgattcattcgaatgatggatctggcgttggagctgcattactcgctgcctcgcactctcagtacctcgatgactctcaaacaagttaa

SEQ ID NO: 726 - protein, 499 aa, Brassica oleracea
MGKVAVGATVVCAAAVCAASVYIVRRRMQSSGKWARVIEILRVLEEDCATPIGKLRQVADAMTVEMHAGLASEGGSKLKMLISYVDNLPSGEEHGFFYALDLGGTNFRVMRVLLGGKQGRVVKQEAKEVSIPPHLMTSGSDELFNFIAEALANFVATEGEDFHLPEGRQRELGFTFSFPVKQTSLSSGTLIKWTKGFSIEDTVGQDVVGALVKAMERVGLDMNVTALVNDTVGTLAGGRYYNPDVVAAVILGTGTNAAYVERAHAIPKWHGLLPKSGEMVINMEWGNFRSSHLPLTEYDHLLDFDSLNPGEQILEKIISGMYLGEILRRVLLKMADEAAFFGDSVPPKLRIPFIIRTPNMSAMHSDTSPDLKVVGSKLKDILEVPTTSLKMRKVVVSLCDIIACRGARLSAAGIYGILKKLGRDAPKDGETQKSVIAMDGGLFEHYTQFSECMESSLKELLGDEASDSVEVIHSNDGSGVGAALLAASHSQYLDDSQTS

SEQ ID NO: 727 - DNA, 1500 bp, Brassica oleracea
  CDS (1)..(1500)
atgggtaaagtggctgtcggtgcgacggttgtttgcgctgcggcggtttgcgcggcgacggtgtatgtggtgaggcggcggatgaaaagctgcgggaaatgggggcgcgtgatagagatcctgaaggtgttcgaggaggattgcgcgacgccgatagggaagctgagacaagtggcggatgcgatgacggttgagatgcacgcgggtctcgcatcggaaggtggaagcaagcttaagatgctcatcagctacgtcgacaatctcccttctggggatgaacaaggtttcttttacgcgctggacctaggaggaacaaacttccgtgtcatgcgtgtgcttctcggtggcaaacaagaccgtgttgtcaaacaagaattcgaagaagtctctatccctcctcctttgatgaccggtgcttcagatgaattgttcaattttatcgctgaagcgcttgcaaagttcgtcgctacggaaggagaggactttcatctcccagcgggtagacaaagggagttaggtttcactttctcgtttcctgttaagcagacgtctttgtgctctggcactctcatcagctggactaaaggcttctccatcgaagatgcacttggacaagatgttgtgggagagcttattaaagctatggaaagagttgggctcgacatgaatgtcacagcgcttgttaatgatacggttggaacacttgctggtggtagatactataactctgatgttgtagccgctgttattctaggcactggcactaatgcagcttatgtcgaacgcgcaaatgccattccaaaatggcagggcttacttcccaaatctggagaaatggtgatcaacatggagtggggaaacttcaggtcatcacatcttcccttgaccgagtacgaccacttgctggatttcgatagtttgaatcctggtgaacagattcttgagaaaataatttccggtatgtatttgggagagatcttgcgtagagttcttctgaagatggctgaagaggctgctttctttggcgactccatcccacctaagctgaaagtaccattcatcataaggactccgaccatgtctgctatgcacagcgacacttctccggatttgaaggttgttggaagcaagttaaaggacatactggaggtccctactactctgaagatgagaaaagttgtgatcagtctctgtaacatcatagccacccgaggagctcgtctctctgcagctgggatctacggaatcctcaagaaactaggaagagacgcacctaaagatggagaaacaacgcagaaatctgtgattgccatggacggtggactgttcgagcactacactcagttcagtgagtgtatggagagctcattgaaagagttgcttggagatgaagcatcagagagcgtcgaggtgattcattcgaatgacgggtccggcgttggcgctgcattgctcgctgcctcgcactctcagtacctcgaggactctgaaacaagttaa

SEQ ID NO: 728 - protein, 499 aa, Brassica oleracea
MGKVAVGATVVCAAAVCAATVYVVRRRMKSCGKWGRVIEILKVFEEDCATPIGKLRQVADAMTVEMHAGLASEGGSKLKMLISYVDNLPSGDEQGFFYALDLGGTNFRVMRVLLGGKQDRVVKQEFEEVSIPPPLMTGASDELFNFIAEALAKFVATEGEDFHLPAGRQRELGFTFSFPVKQTSLCSGTLISWTKGFSIEDALGQDVVGELIKAMERVGLDMNVTALVNDTVGTLAGGRYYNSDVVAAVILGTGTNAAYVERANAIPKWQGLLPKSGEMVINMEWGNFRSSHLPLTEYDHLLDFDSLNPGEQILEKIISGMYLGEILRRVLLKMAEEAAFFGDSIPPKLKVPFIIRTPTMSAMHSDTSPDLKVVGSKLKDILEVPTTLKMRKVVISLCNIIATRGARLSAAGIYGILKKLGRDAPKDGETTQKSVIAMDGGLFEHYTQFSECMESSLKELLGDEASESVEVIHSNDGSGVGAALLAASHSQYLEDSETS

SEQ ID NO: 729 - DNA, 1491 bp, Lycopersicon esculentum
  CDS (1)..(1491)
  misc_feature (771)..(771): w is a or t
  misc_feature (786)..(786): k is g or t
  misc_feature (798)..(798): y is t or c
  misc_feature (1192)..(1192): n is a, g, c or t
atgaagaaggcgacggtgggtgcggtggtggtaggtacagcggcggcggtagctgtggcggcgctcgtcatgcgccaccgcatgggtaaatcgagcaaatgggcacgtgccagggcaattctgaaggaattcgaggagaaatgtgccaccccagatgccaagctgaagcaagtggctgatgctatgacggtggagatgcacgccggactcgcctctgaaggaggcagcaagctcaagatgcttattagctatgtagacaatctccctactggtgatgaagcaggagtcttttatgcattggatcttggtggaacgaattttcgagtattgcgggtacagttggggggaaaagatggtgggattatgcatcaagaatttgcggaggcatcaattcctccaaatttgatggttggaacttcagaagccctttttgactatattgcggcagaacttgcaaaattcgtagatgaagaaggagaaaaatttcatccacctcctggtaagcagagagaattaggcttcaccttctcgttcccaataatgcagacttcaatcaattctggaactcttatcaggtggacgaaaggtttctccattgatgacacggttggcaaagatgttgttgcagaactgacaaaagcaatgcaaaaacgagaaattgatatgagggtgtcagcgcttgtgaatgatactgttggaacattggctggtggtagattcacggataaggatgtatccattgctgtgatattaggtactgggacaaatgcwgcatatgtggaacgkgctcaggcaatycccaaatggcacggtcctctgcctaactctggagaaatggtgatcaatatggaatggggtaactttaggtcctcccatcttcccttgacacagtatgataatgctatggataccgatagtttaaatcccggtgaacagatatttgagaagatatgttctggtatgtacttgggagaaattttacgcagagttctacttagaatggctaaagaagctggcatttttggcgaggaagttcctccaaaactcaagaattcattcatattgaggacacctgaaatgtctgctatgcatcatgacacatcctctgatttgagagtggttggcgacaagttgaaggatatcttagagatatccaatacctccttgaagacaaggagattagttgttgagntgtgtaatattgttgcaacacgtggcgccagacttgcggcagctggtatcttgggcattatcaaaaagatgggaaaggatacaccgagggaaagtggtccagaaaagattgtggtagccatggatggcggattgtatgagcactatacagaatacagcaagtgcttggaaaacacattggttgaattgcttggaaaggaaatggcaacaagcattgtcttcaagcacgcgaatgatggttctggcattggcgctgcactcctcgcggcctccaactctgtgtatgttgaagacaagtga

SEQ ID NO: 730 - protein, 496 aa, Lycopersicon esculentum
  misc_feature (398)..(398): The Xaa at location 398 stands for Leu, Met, or Val.
MKKATVGAVVVGTAAAVAVAALVMRHRMGKSSKWARARAILKEFEEKCATPDAKLKQVADAMTVEMHAGLASEGGSKLKMLISYVDNLPTGDEAGVFYALDLGGTNFRVLRVQLGGKDGGIMHQEFAEASIPPNLMVGTSEALFDYIAAELAKFVDEEGEKFHPPPGKQRELGFTFSFPIMQTSINSGTLIRWTKGFSIDDTVGKDVVAELTKAMQKREIDMRVSALVNDTVGTLAGGRFTDKDVSIAVILGTGTNAAYVERAQAIPKWHGPLPNSGEMVINMEWGNFRSSHLPLTQYDNAMDTDSLNPGEQIFEKICSGMYLGEILRRVLLRMAKEAGIFGEEVPPKLKNSFILRTPEMSAMHHDTSSDLRVVGDKLKDILEISNTSLKTRRLVVEXCNIVATRGARLAAAGILGIIKKMGKDTPRESGPEKIVVAMDGGLYEHYTEYSKCLENTLVELLGKEMATSIVFKHANDGSGIGAALLAASNSVYVEDK

SEQ ID NO: 731 - DNA, 1497 bp, Citrus sinensis
  CDS (1)..(1497)
atggggaaagtgacggtagcggcgacggtggtgtgcgcggcggcggtgtgtgcggcggcggcgctggtggtgaggcgtaggatgaagagcacggggaggtgggccagggcggttgctatattgaaggagatggaggagaagtgtgggacccccatagggaagctgaggcaggtagctgatgcgatgacggtggagatgcacgccggcctcgcgtcggagggcggcagcaagctcaagatgctcatcagctatgtcgataatctccccactggggatgagaagggattgttttatgcattggacctgggcggcacaaacttccgtgtcctgcgagtacagttgggtggaagagaaggccgtgttgttaaacaagaatttgaggaagtttcaattcctccacatttgatgactgggagttcgcatgaattatttgactatattgctgcagcactcgcaaaatttgttgctactgaaggtgaaggatttcatgtttcaccaggtagacaaagagagttgggttttaccttctcatttcctgttaggcaaacatcaatagcatcaggggatcttataaagtggaccaagggcttctctattgaggatacggttggagaagatgtagtcggagaattgactaaagccatggaaagaatcgggcttgatatgcgtgtggcagctttggtgaatgacaccatcggaacattagctggtggtagataccacaacaaggatgccattgctgctgtaatcttgggcactggaactaatgcagcatatgtagagcgagcacatgcaattcccaagtggcatggtcttctgcctaaatcaggggaaatggttatcaatatggaatggggtaatttccggtcatcgcaccttccactaacagaatatgatgaagcattggacactgagagtttgaaccccggtgaacagatttttgaaaaaatcatctctggcatgtatttgggagaaattgtacgcagagtcttgtgcaggatggcagaggaagctaacttttttggtgatactgttcctccaaaattgaaaattccattcatattgaggactcctcacatgtcggctatgcatcacgacacatctccagatttgagagtagttgggaagaaactaaaggatatattagagatatccaatacctctttgaagatgagaaaacttgttgttgagctctgtgacatagttgcaactcgaggtgcccgcctatctgctgcagggattgtaggcatcctcaagaaattaggacgagacacagtaagagatggggaaaaacagaagtcagtaatagcattggatggcggtttgtttgagcactacacgaaatttagtgcctgcatgcagagcacggtcaaggagttgctgggagaggaagtttctgagaccgtcgtcattgagcattctaatgatggatcaggcattggagccgcactccttgcagcttcgcactcccaataccttgaggttgaagagtcttga

SEQ ID NO: 732 - protein, 498 aa, Citrus sinensis
MGKVTVAATVVCAAAVCAAAALVVRRRMKSTGRWARAVAILKEMEEKCGTPIGKLRQVADAMTVEMHAGLASEGGSKLKMLISYVDNLPTGDEKGLFYALDLGGTNFRVLRVQLGGREGRVVKQEFEEVSIPPHLMTGSSHELFDYIAAALAKFVATEGEGFHVSPGRQRELGFTFSFPVRQTSIASGDLIKWTKGFSIEDTVGEDVVGELTKAMERIGLDMRVAALVNDTIGTLAGGRYHNKDAIAAVILGTGTNAAYVERAHAIPKWHGLLPKSGEMVINMEWGNFRSSHLPLTEYDEALDTESLNPGEQIFEKIISGMYLGEIVRRVLCRMAEEANFFGDTVPPKLKIPFILRTPHMSAMHHDTSPDLRVVGKKLKDILEISNTSLKMRKLVVELCDIVATRGARLSAAGIVGILKKLGRDTVRDGEKQKSVIALDGGLFEHYTKFSACMQSTVKELLGEEVSETVVIEHSNDGSGIGAALLAASHSQYLEVEES

SEQ ID NO: 733 - DNA, 1515 bp, Oryza sativa
  CDS (1)..(1515)
atggaggggagggcggcggggtgggtgagggtggcggcggtggggtgggcggtggcggcgtgcgcggtggcggcggggatggtggcgaggcgaggggcggcgagggtgcggtggaacagggcggtggcggtggtgcgggacctggaggagcggtgcgccacgcccgcggagctgctgcagcgggtggtcaactcgctggccatcgagatgttcgccggcctcgcctccgacggcgggagcaaggtgcggatgctgctcacctgcgtcgacgcgctccccgacgggagcgaggaaggcatcagttatgccattgatcttggaggaacaagctttagagtcctgaaagtagaacttggcgcagggtctacaatcatcaatcgaaaagttgaacatcagcctatccccgaaaatttgactaagggtacaagcgatgatttgttcaatttcattgcctcggcactgaagaattttattgaaagagagggtggggaggttgaggggagggcacttggttttacattttctttccctgtgagacagacttccatttcctcggggacattaattcgatggactaaagaattttcaattgaagaggctgtcgggaaagatgttgctcagtgcctaaatgaagcccttgctaggaatggactcaatatgaaggtcaatgtattggtgaacaatactgtggggacattagctctcgggcattattatgatgatgacacagtagctgctgtgattattggagctggcaccaatgcttgctatattgaacgcaacgatgcaattattaaatctttgggtcgcgttaccaattctgaacgaacggtagtaaatgtggaatggggtagttttcggcctccacaaatagaattgactccttatgatatatgcttcaacaacgaaacatggaattattatgaccagggttttgagaaaatgatctctggtgtgtatcttggggaaattgcaagattggtgttccaaaaaatggctgaagagtcagatatatttggtactgctgttgatggtctatcgacccctttcgtcttaagtacaccaaacttagctgctatccgcgaggatgattccccggacttgagagaagtcggcaagatacttgaggaacatcttaagctaccagatgttcccctcaagacccggaagcttgttgccagagtctccgacatcatcacccggagagctgcccgcctagcagcggctgcgattgtcgcgatactgcaaaagatcggctgcgatggaaccctttgtggttcaactcaggttcgaacaatgcgaggcgtgcgaagaagaacggtggtcgcgatcgagggcggcctcttcgaaggctactcggtcttcagagagtatctgaatgaagctctagttgagatccttggagaggagattgcagccactgttagtcttagggtgatggaggagggatctgggactggtgctgccctccttgcagctgcatattcatcggctaggcagaagaactccgagtag

SEQ ID NO: 734 - protein, 504 aa, Oryza sativa
MEGRAAGWVRVAAVGWAVAACAVAAGMVARRGAARVRWNRAVAVVRDLEERCATPAELLQRVVNSLAIEMFAGLASDGGSKVRMLLTCVDALPDGSEEGISYAIDLGGTSFRVLKVELGAGSTIINRKVEHQPIPENLTKGTSDDLFNFIASALKNFIEREGGEVEGRALGFTFSFPVRQTSISSGTLIRWTKEFSIEEAVGKDVAQCLNEALARNGLNMKVNVLVNNTVGTLALGHYYDDDTVAAVIIGAGTNACYIERNDAIIKSLGRVTNSERTVVNVEWGSFRPPQIELTPYDICFNNETWNYYDQGFEKMISGVYLGEIARLVFQKMAEESDIFGTAVDGLSTPFVLSTPNLAAIREDDSPDLREVGKILEEHLKLPDVPLKTRKLVARVSDIITRRAARLAAAAIVAILQKIGCDGTLCGSTQVRTMRGVRRRTVVAIEGGLFEGYSVFREYLNEALVEILGEEIAATVSLRVMEEGSGTGAALLAAAYSSARQKNSE

SEQ ID NO: 735 - DNA, 1491 bp, Arabidopsis thaliana
  CDS (1)..(1491)
atgggtaaagtagctgttggagcgactgttgtttgcacggcggcggtttgtgcggtggctgttttggttgttcgacgacggatgcagagctcagggaagtggggacgtgttttggctatcctcaaggcctttgaagaggattgtgcgactccgatctcgaaactgagacaagtggctgatgctatgaccgttgagatgcatgctggtcttgcatccgacggtggtagcaaactcaagatgcttatcagctacgttgataatcttccttccggggatgaaaagggtctcttttatgcattggacctaggggggacaaacttccgtgtcatgcgtgtgcttcttggcgggaagcaagagcgtgttgttaaacaagaattcgaagaagtttcgattcctcctcatttgatgactggtggttcagatgagttgttcaattttatagctgaagctcttgcgaagtttgtcgctacagaatgcgaagactttcatcttccagaaggtagacagagggaattaggtttcactttctcgtttcctgttaagcagacttctctgtcctctggtagtctcatcaaatggacaaaaggcttttccatcgaagaagcagttggacaagatgttgttggagcacttaataaggctctggaaagagttggtcttgacatgcgaatcgcagcacttgttaatgataccgttggaacactagccggtggtagatactataacccggatgttgttgctgctgttattttaggcactgggacaaacgcagcctatgttgagcgtgcaaccgcgatccctaaatggcatggtctgcttccaaaatcaggagaaatggttataaacatggaatggggaaacttcaggtcatcacatcttccattaaccgagtttgatcacacgctggatttcgagagtctgaatccaggcgaacagattcttgagaaaatcatttccggtatgtacttgggagagattttgcgaagagttcttctaaagatggctgaagatgctgctttctttggcgatacagtcccatctaagctgagaataccattcatcattaggactcctcacatgtcggctatgcacaacgacacttctccagacttgaagattgttgggagcaagattaaggatatattggaggtccctacaacttctctgaaaatgagaaaagttgtgatcagtctctgcaacatcatagcaacccgaggagctcgtctctctgctgctggaatctatggtattctgaagaaactgggaagagatactactaaagacgaggaggtgcagaaatcggttatagccatggatggtggattgtttgagcattacactcagtttagtgagtgtatggagagctcactaaaagagttgcttggagatgaagcttcaggaagcgttgaagtcactcactccaatgatggatcaggcattggagctgcgcttcttgctgcttctcactctctctaccttgaagactcttaa

SEQ ID NO: 736 - protein, 496 aa, Arabidopsis thaliana
MGKVAVGATVVCTAAVCAVAVLVVRRRMQSSGKWGRVLAILKAFEEDCATPISKLRQVADAMTVEMHAGLASDGGSKLKMLISYVDNLPSGDEKGLFYALDLGGTNFRVMRVLLGGKQERVVKQEFEEVSIPPHLMTGGSDELFNFIAEALAKFVATECEDFHLPEGRQRELGFTFSFPVKQTSLSSGSLIKWTKGFSIEEAVGQDVVGALNKALERVGLDMRIAALVNDTVGTLAGGRYYNPDVVAAVILGTGTNAAYVERATAIPKWHGLLPKSGEMVINMEWGNFRSSHLPLTEFDHTLDFESLNPGEQILEKIISGMYLGEILRRVLLKMAEDAAFFGDTVPSKLRIPFIIRTPHMSAMHNDTSPDLKIVGSKIKDILEVPTTSLKMRKVVISLCNIIATRGARLSAAGIYGILKKLGRDTTKDEEVQKSVIAMDGGLFEHYTQFSECMESSLKELLGDEASGSVEVTHSNDGSGIGAALLAASHSLYLEDS

SEQ ID NO: 737 - DNA, 1497 bp, Oryza sativa
  CDS (1)..(1497)
atggcggcggcggcggtggcggcagatcagaaggtggtgacgatgacgagcctccgggagggctgcgcttgcgcggcgcctcctgctgcagctgcgccgccgatgccgaagatggcggcggcgcagagggtggtggcggagctgagagaagcgtgcgcgacgccggcggcgaggctggcggaggtggccgcggcgatggccggcgagatggaggccgggctggcggtggagggcggcagcagcgagatgaagatgatcgtgtcgtacgtcgacagcctccccaccggcggcgaggaggggtcgtactacgcgctcgacctcggcggcaccaacttccgcgtcctccgcgtgcggcttgccggcggcggcgtcgccgagcgcgtggcgagggaggtcccgatccctcccggcctcatgtccggcggcggcgccacctcggagtgcctcttcggcttcatcgcctccgcgctagccgagttcgtcggcgaggaggaagaagaaggcggcctcgacggcggcgagagggagcttgggttcaccttctccttccccgtgcaccaaacctccatcgcgtcggggacgctcatccggtggacgaaggcgttcgccgtcgacgacgcgatcggcgaggacgtcgtggcggcgctgcaggcggccatgtcggagcgggggctcgacatgcgcgtgtcggcgctcatcaacgacaccgtcgggacgctcgccgcgggcagctactacgacgaggacgtcgtggccgccgtcatcctcggcaccggcacgaacgccgcctacgtcgaggacgccaccgccatcgccaagctacacccatcgcagctgccagcatcgaacaccatggtgatcaacaccgagtggggcagcttcgcctcgccgtgcctcccattgacggagttcgacgaagcactcgatcaggagagcctcaaccccggcgagcagacctacgagaagctcatctccgggatgtacctcggcgagatcgtcaggagggtcctcctcaagatctcctcccggtgcccctccctcctcggcggcgccggcgagctcgcgacgccgttcgtcctcaggacacccgacgtgtccgcgatgcaccacgacgagacgcccgacctgagcatcgtcggcgagaagctggaacgcacgctgggcatccgcggcacgtcgccggaggcgaggaggatggtcgtcgaggtgtgcgacatcgtcgccacgagggccgcccggctggccgcggcggggatcgtcgggatcctgaagaagatcgggagggtcgacggcggcgaggggcggaggaggaggtcggtggtcgccgtggacggcgggctgttcgagcactacggcaagttccggcggtgcatggagagcgcggtgagggagctgctcggagaggcggcggcggagagggtggtcgtcaagctcgccagcgacggctccgggctcggcgccgccctggttgcagctgctcactcgcagagagcataa

SEQ ID NO: 738 - protein, 498 aa, Oryza sativa
MAAAAVAADQKVVTMTSLREGCACAAPPAAAAPPMPKMAAAQRVVAELREACATPAARLAEVAAAMAGEMEAGLAVEGGSSEMKMIVSYVDSLPTGGEEGSYYALDLGGTNFRVLRVRLAGGGVAERVAREVPIPPGLMSGGGATSECLFGFIASALAEFVGEEEEEGGLDGGERELGFTFSFPVHQTSIASGTLIRWTKAFAVDDAIGEDVVAALQAAMSERGLDMRVSALINDTVGTLAAGSYYDEDVVAAVILGTGTNAAYVEDATAIAKLHPSQLPASNTMVINTEWGSFASPCLPLTEFDEALDQESLNPGEQTYEKLISGMYLGEIVRRVLLKISSRCPSLLGGAGELATPFVLRTPDVSAMHHDETPDLSIVGEKLERTLGIRGTSPEARRMVVEVCDIVATRAARLAAAGIVGILKKIGRVDGGEGRRRRSVVAVDGGLFEHYGKFRRCMESAVRELLGEAAAERVVVKLASDGSGLGAALVAAAHSQRA

SEQ ID NO: 739 - DNA, 1497 bp, Solanum tuberosum
  CDS (1)..(1497)
atgaagaaagtgacggtgggagccgccgtggttggtgcagctgcggtgtgtgcagtggcggcgttaatagtgaaccaccggatgcggaaatctagtaaatggggtcgtgctatggctattcttcgtgaatttgaggaaaagtgtaagactcaagatgcaaagcttaagcaagttgctgatgctatgactgttgagatgcacgccggacttgcttctgaaggcggccagagctcaagatgcttatcacctatgtcgataatctcccaactggtgatgaagctgggcgtcttttatgcattggatcttggtggaacaaattttcgagtattgcgagtgcaattgggtggaaaagatggtggtattattcatcaagaatttgctgaggcatcaattcctccaagtttgatggttgggacttcagatgcactttttgattatattgcggctgagcttgctaaatttgttgctgcggaagaggaaaaatttcatcaacctcctggtaagcagagagaactaggttttcaccttctcattcccagtaatgcagacttcaataactctgggactattatgcggtggacaaaaggcttctcaattgatgatgcggttggccaagatgttgttggagaactcacaaaagctatgaaagaaaaggtgctcgatatgcgggtctcagctctggtgaatgatactgttggaacattagctggtggtaaatatacgcaaaaggatgtagctgttgctgttatcttaggtacagggacgaatgcagcttatgtggagcgggtgcaggcaattccaaagtggcatggtcctgtgccaaaatctggtgaaatggttatcaatatggaatggggtaattttaggtcatcccatctgccgttgacagagtatgatcatgcgttggataacgagagtttaaatcctgctgaacagatatttgagaagatgacttctggcatgtacttgggagaaattttacgcagagttctcactagggtggctgaagaagtcctggcgtttttggcgatgaggtccctccaaagcctcaaggattcatttgtgttaaggacacctgatatgtctgctatgcatcatgacacatcccctgatctgaaagtggttggtgaaaagctgaaggatattttagagatatctaatacctccttgaagacaaggaaattagtgttgagcctgtgcaatatcgttgcaacacgtggggcaagacttgacgctgcaggggtattgggcatcttgaaaaagatgggaagagatacgcctaagcagggtggttcagaaaggacggttatagccatggatggcgggttgtatgagcactatacagaatatagaatgtgtttagagaactctttgaaggacttgctcggagaggaattggcaacgagcatcgtttttgtgcactccaatgatggttctggcattggtgctgctcttcttcgtgcctctcattcaatgtaccttgaagatcaagcttag

SEQ ID NO: 740 - protein, 498 aa, Solanum tuberosum
MKKVTVGAAVVGAAAVCAVAALIVNHRMRKSSKWGRAMAILREFEEKCKTQDAKLKQVADAMTVEMHAGLASEGGQSSRCLSPMSIISQLVMKLGVFYALDLGGTNFRVLRVQLGGKDGGIIHQEFAEASIPPSLMVGTSDALFDYIAAELAKFVAAEEEKFHQPPGKQRELGFHLLIPSNADFNNSGTIMRWTKGFSIDDAVGQDVVGELTKAMKEKVLDMRVSALVNDTVGTLAGGKYTQKDVAVAVILGTGTNAAYVERVQAIPKWHGPVPKSGEMVINMEWGNFRSSHLPLTEYDHALDNESLNPAEQIFEKMTSGMYLGEILRRVLTRVAEEVLAFLAMRSLQSLKDSFVLRTPDMSAMHHDTSPDLKVVGEKLKDILEISNTSLKTRKLVLSLCNIVATRGARLDAAGVLGILKKMGRDTPKQGGSERTVIAMDGGLYEHYTEYRMCLENSLKDLLGEELATSIVFVHSNDGSGIGAALLRASHSMYLEDQA

SEQ ID NO: 741 - DNA, 1497 bp, Spinacia oleracea
  CDS (1)..(1497)
atgaggaaggcagcggtcggagcagcggtggtatgtacagcggcggtgtgtgcggcggcagcggtgttggtaagacagaggatgaagagctcaagcaagtggggtcgtgtaatggcaatactgaaggagttagatgacaattgtgggacccctttgggtaagcttagacaggtggctgatgctatgaccgttgagatgcacgctggtcttgcatctgagggtgcttctaagctcaagatgctcatcagctacgttgacaatctccccactggggacgagcatggactgttctatgcgttagaccttggcggcaccaacttccgagtgcttcgagtaaagttgggtggcaaagaaaaacgtgttgtcgaacaagaatttgacgaagtatcaattccacctgagttgatggttggtacatcagaacaactgtttgattatatcgccgaagccctagccaaatttgttgcaacggaaagtgaaggtcttcatcctgaacccaataaacagagagagctgggatttaccttctctttccctgtcaagcagacatcaatcgcatcagggactcttataagatggaccaagggctttaatatagaagatacagttggtgaagatgtggtggctgaattgaccaaggccatgctaagaaaaggtgtagatatgcgtgtgacagctttggtcaacgatacagttggaaccctagctggaggtaggtactataaagaagatgtaattgctgctgttatattgggtactggaacaaacgcagcttacgttgaacgtgctagtgcaattcacaagtggcatggtcctttgcccaaatcaggggagatggtaattaacatggagtggggtaatttccgttcatcgtatttacctttgactgaatatgacatagcactagatgaagaaagtttgaatcctggtgaacagatatttgagaaaatgatatcaggaatgtacttgggtgagattgtgcgaagagtcttgtataggatggcagacgaggccagcctttttggtgatacagtcccatcaaaattgaaaactccattcatcttaaggacaccagacatgtctgccatgcatcatgacacatcacctgatcttaaagttgttgcgagcaaactgaaggatgtccttgggataccaaactcatcattaaaggtgcgaaagattatagttgacgtatgtgacgtcattgcttcacgtggggcctgcatttctgcagccgggatcttgggtattattaagaaactagggagagacacattgaagcaaggtgagaaccagaagtctgtgattgcattagatggagggttgtttgagcactacgccaaattccgggagtgcatggaggactctttgaaggagctcctaggcgatgaagtcgctgaaactattgtaattgagcactcaaatgatggatcaggcattggtgctgctcttctagcagcgtcgcattcccagtacctcgaggaagatgaatcttga

SEQ ID NO: 742 - protein, 498 aa, Spinacia oleracea
MRKAAVGAAVVCTAAVCAAAAVLVRQRMKSSSKWGRVMAILKELDDNCGTPLGKLRQVADAMTVEMHAGLASEGASKLKMLISYVDNLPTGDEHGLFYALDLGGTNFRVLRVKLGGKEKRVVEQEFDEVSIPPELMVGTSEQLFDYIAEALAKFVATESEGLHPEPNKQRELGFTFSFPVKQTSIASGTLIRWTKGFNIEDTVGEDVVAELTKAMLRKGVDMRVTALVNDTVGTLAGGRYYKEDVIAAVILGTGTNAAYVERASAIHKWHGPLPKSGEMVINMEWGNFRSSYLPLTEYDIALDEESLNPGEQIFEKMISGMYLGEIVRRVLYRMADEASLFGDTVPSKLKTPFILRTPDMSAMHHDTSPDLKVVASKLKDVLGIPNSSLKVRKIIVDVCDVIASRGACISAAGILGIIKKLGRDTLKQGENQKSVIALDGGLFEHYAKFRECMEDSLKELLGDEVAETIVIEHSNDGSGIGAALLAASHSQYLEEDES

SEQ ID NO: 743 - DNA, 1494 bp, Nicotiana tabacum
  CDS (1)..(1494)
atgaagaaagcgacggtgggagccgccgtaattggcgccgctacggtatgtgcagtggcggcattaatagtgaaccaccgtatgcgcaaatctagcaaatgggcacgtgctatggctattcttcgtgaatttgaggaaaagtgtgggacccctgatgctaagctcaagcaagtcgctgatgctatgaccgtcgagatgcacgctggacttgcctccgaaggtggtagcaagctcaagatgcttatcacttacgtcgataatctccccaccggtgatgaagctggcgtcttttatgcgttggatcttggtggaacaaattttcgagtattgcgagtgcaacttggtggaaaagatggtggtattgttcatcaggaatttgcggaggcatcaattcctccaaatttgatggttgggacttcagaagcactttttgattatattgcggcagaacttgcaaaatttgtcaacgaggaaggggaaaagtttcaacaacctcctggtaagcagagagaactaggtttcaccttctcattcccggtaatgcagacttcaatcaactctgggactattatgaggtggacaaagggcttctccattgatgatgcggttggccaagatgttgttggagaactcgcaaaagctatgaaaagaaaaggagttgatatgcgggtctcagctttggtgaatgatactgttgggacgttggctggtggtaaatatacacacaacgacgtagctgttgctgttatcttaggtacagggaccaatgcagcctatgtggaacgggtgcaggcgattccaaagtggcatggtcctgtgccaaaatctggtgaaatggttatcaacatggaatggggtaattttaggtcatcccatcttcccttgacacagtatgatcatgcgttggatactaatagtttgaatcctggtgatcagatatttgagaagatgacttctggcatgtacttgggagaaattttacgcagagttctactcagggtggccgaagaagctggcatttttggtgatgaggtccctccaaagctcaagagtccatttgtattgaggacacctgatatgtctgcgatgcatcatgacgcatcctctgatctgagagtggttggtgacaagctgaaggatattttagagatatctaatacctccttgaagacaaggagattagtcattgagctgtgcaacatcgttgcgacacgtggggcaaggcttgcagctgcgggtgtattgggcatcttgaaaaagatgggaagggatactcctcggcaaggtggtctagagaagacggttgtagccatggatggcggattgtacgagcactatacagaatacaggatgtgcttagagaacactttgaaggaattgcttggagatgaattggcgacaagcattgttttcgagcactccaatgatggttctggcattggtgcagctcttcttgctgcctctaactcaatgtaccttgaagataagtcctag

SEQ ID NO: 744 - protein, 497 aa, Nicotiana tabacum
MKKATVGAAVIGAATVCAVAALIVNHRMRKSSKWARAMAILREFEEKCGTPDAKLKQVADAMTVEMHAGLASEGGSKLKMLITYVDNLPTGDEAGVFYALDLGGTNFRVLRVQLGGKDGGIVHQEFAEASIPPNLMVGTSEALFDYIAAELAKFVNEEGEKFQQPPGKQRELGFTFSFPVMQTSINSGTIMRWTKGFSIDDAVGQDVVGELAKAMKRKGVDMRVSALVNDTVGTLAGGKYTHNDVAVAVILGTGTNAAYVERVQAIPKWHGPVPKSGEMVINMEWGNFRSSHLPLTQYDHALDTNSLNPGDQIFEKMTSGMYLGEILRRVLLRVAEEAGIFGDEVPPKLKSPFVLRTPDMSAMHHDASSDLRVVGDKLKDILEISNTSLKTRRLVIELCNIVATRGARLAAAGVLGILKKMGRDTPRQGGLEKTVVAMDGGLYEHYTEYRMCLENTLKELLGDELATSIVFEHSNDGSGIGAALLAASNSMYLEDKS

SEQ ID NO: 745 - DNA, 1509 bp, Arabidopsis thaliana
  CDS (1)..(1509)
atgggtaaagtggcagttgcaacgacggtagtgtgttcggtggcggtatgtgcggcggcggcgttgatagtacggaggagaatgaaaagcgcagggaaatgggcaagagtgatagagatattgaaagcctttgaagaagattgtgcaacgccaattgccaaattgagacaagtggctgatgctatgactgttgagatgcatgctggtcttgcttctgaaggtggcagcaagcttaagatgcttattagctacgttgataatcttccttctggggatgagactggttttttctatgcgttggatctaggcggaacaaacttccgtgttatgcgtgtgcttcttggtgggaagcacgaccgtgttgttaaacgagaattcaaagaagaatctattcctcctcatttgatgaccgggaagtcacatgaattattcgattttatcgttgatgttcttgccaagtttgtcgctacagaaggcgaggactttcatctcccacctggtagacaacgggaactaggttttactttctcatttccggttaagcagctatctttatcctctggcactctcatcaactggacgaagggcttttccattgacgatacagttgataaagatgttgttggagaacttgttaaagctatggaaagagttgggctggacatgcttgtcgcagcgcttgttaatgataccattggaacacttgcgggtggtagatacactaacccggatgtcgttgtcgcagttattttgggcaccggcacaaatgcagcctatgtcgaacgtgcacatgcaattcccaaatggcatggtttgctacccaaatcaggagaaatggtgatcaacatggaatggggaaacttcaggtcatcacatcttccattgacagagtacgaccactctctagatgtcgatagtttgaatcctggtgaacagattcttgagaaaatcatttccggaatgtatctgggagaaatcttgcgtagagttcttctgaagatggctgaagaagctgccttctttggcgatatcgtcccacctaagctgaaaataccattcatcataaggaccccgaacatgtctgctatgcacagtgatacttccccggatttgaaggttgtaggaagcaagttaaaagacatattggaggtccagactagttctctgaagatgaggaaagttgtgatcagcctatgtaacatcattgcaagccgaggagctcgtttatctgctgcggggatctatggaatcctcaagaaaataggaagagacgcaacaaaagatggagaagctcagaaatctgtgatagcgatggacggtgggctattcgagcattacactcagttcagtgagtcgatgaagagttcattgaaagagttgcttggagatgaagtttcagagagtgttgaagtgatactgtcgaatgatggttcaggtgttggagctgcattacttgctgcttctcactctcagtatctcgaacttgaagatgactctgaaacaagttaa

SEQ ID NO: 746 - protein, 502 aa, Arabidopsis thaliana
MGKVAVATTVVCSVAVCAAAALIVRRRMKSAGKWARVIEILKAFEEDCATPIAKLRQVADAMTVEMHAGLASEGGSKLKMLISYVDNLPSGDETGFFYALDLGGTNFRVMRVLLGGKHDRVVKREFKEESIPPHLMTGKSHELFDFIVDVLAKFVATEGEDFHLPPGRQRELGFTFSFPVKQLSLSSGTLINWTKGFSIDDTVDKDVVGELVKAMERVGLDMLVAALVNDTIGTLAGGRYTNPDVVVAVILGTGTNAAYVERAHAIPKWHGLLPKSGEMVINMEWGNFRSSHLPLTEYDHSLDVDSLNPGEQILEKIISGMYLGEILRRVLLKMAEEAAFFGDIVPPKLKIPFIIRTPNMSAMHSDTSPDLKVVGSKLKDILEVQTSSLKMRKVVISLCNIIASRGARLSAAGIYGILKKIGRDATKDGEAQKSVIAMDGGLFEHYTQFSESMKSSLKELLGDEVSESVEVILSNDGSGVGAALLAASHSQYLELEDDSETS

SEQ ID NO: 747 - DNA, 1485 bp, Oryza sativa
  CDS (1)..(1485)
atgaggaaggcggcggcggcggcggtcgcggcagcggcggcggtcggcgtggcgctgctggtgcgccggcagctgcgggaggcgaagcggtggggccgggccgacgcggtgctgcgggagctggaggagcggtgcgcggcgccgccggggcggctgcggcaggtggcggacgcgatggccgtcgagatgcacgccgggctcgcctccgagggcgggagcaaactcaagatgatcatcagctacgtcgacgccctcccttccggggaagagaagggggtgttttatgcgcttgaccttggaggtacaaatttccgtgttttacgggttcaattaggtggcaaggaagggagagttatcaagcaagaacatgacgagatttcaattcctccgcatctgatgactggtggttcaaatgaactatttgattttattgcttcttctttagcaaaatttgttgcttcagagggtgaagactttcatcttgctgaggggaggcagagagaacttggctttacgttctctttcccagtaaagcaaacttcaattgcatctggcactcttattaattggactaagggtttttcgattgatgaaacggttggtgaagatgttgtgactgaattaaccaaggctcttgaacgccaggggcttgatatgaaagtcacagcattgataaatgatactatagggacattggctggtgggagatatgatgataatgatgtcattgctgctgttatactgggaacaggtactaatgcagcatacgtggaacgtgccaatgcaattcctaaatggcatgacctcctgccgaagtcaggagatatggtaataaatatggaatgggggaacttcaggtcatcccatcttcctttgactgaatttgatcaagcattagatgctgaaagtttgaatcctggtgaacaggtttacgaaaagttgatctctggcatgtatttgggagaaattgttcgtagagtcctattaaagatggctgaagaagcttctctttttggtgatgaagtaccaccaaaactcaagattccatttattatcaggactccatacatgtcaatgatgcactgcgacagatcacctgatctcagaacagttggagcgaaactgaaagatatcctgggggtccaaaacacctcccttaaaacaagaaggcttgtggtggatgtctgcgacatcgttgcgaaacgcgccgctcaccttgctgctgcagggatacacgggatcctgaagaagcttgggcgcgacgtccccaacaccgacaagcagaggacggtgatcgccgtcgacggtgggctctacgagcactacaccatcttcgccgagtgcgtggagagcaccctgagggacatgcttggggaggatgtgtcctccaccattgtcatcaagctcgccaaggacgggtcaggcattggcgctgctctccttgctgcggctcattctcaataccgtgaggctgaggagctctag

SEQ ID NO: 748 - protein, 494 aa, Oryza sativa
MRKAAAAAVAAAAAVGVALLVRRQLREAKRWGRADAVLRELEERCAAPPGRLRQVADAMAVEMHAGLASEGGSKLKMIISYVDALPSGEEKGVFYALDLGGTNFRVLRVQLGGKEGRVIKQEHDEISIPPHLMTGGSNELFDFIASSLAKFVASEGEDFHLAEGRQRELGFTFSFPVKQTSIASGTLINWTKGFSIDETVGEDVVTELTKALERQGLDMKVTALINDTIGTLAGGRYDDNDVIAAVILGTGTNAAYVERANAIPKWHDLLPKSGDMVINMEWGNFRSSHLPLTEFDQALDAESLNPGEQVYEKLISGMYLGEIVRRVLLKMAEEASLFGDEVPPKLKIPFIIRTPYMSMMHCDRSPDLRTVGAKLKDILGVQNTSLKTRRLVVDVCDIVAKRAAHLAAAGIHGILKKLGRDVPNTDKQRTVIAVDGGLYEHYTIFAECVESTLRDMLGEDVSSTIVIKLAKDGSGIGAALLAAAHSQYREAEEL

SEQ ID NO: 749 - DNA, 1491 bp, Solanum tuberosum
  CDS (1)..(1491)
atgaagaaggcgacggtgggtgcggtggtcgtaggtacagcggcggcggtagctgtggcggcgctcatcatgcgccaccgcatgggtaaatcgagcaaatgggcacgtgccagggcaattctgaaggaattcgaggagaaatgtgccaccccagatggcaagctgaagcaagtggctgatgccatgacggtggagatgcacgccggactcgcctctgaaggcggcagcaagctcaagatgcttattagctatgtcgataatctccctactggcgatgaaggaggagtcttttatgcattggatcttggtggaacaaattttcgagtattgcgggtgcaattggggggaaaagatggtggcattatccatcaagaatttgcggaggcatcaattcctccaaatttgatggttggaacttcagaagcactttttgactatattgcggcagaacttgcaaaattcgtagctgaagaaggagaagagtttcatccacctcctggtaggcagagagaattaggcttcaccttctcgttcccaataatgcaaacttcaatcaattctggaactcttatcaggtggacgaaaggtttctccattgatgacacggttggcaaagatgttgttgcagaactgacaaaagcaatgcaaaaacgagaaattgatatgagggtctcagcgcttgtgaatgatactgttggaacattggctggtggtagattcaccaataaggatgtatccattgctgtgatattaggtactgggaccaatgcagcatatgtggaacgggctcaggcaattcccaaatggcacggtcctctgcctaaatctggagaaatggtgatcaatatggaatggggtaactttaggtcctcccaccttcccttgacagagtacgatcatgctatggataccaatagtttaaatcctggtgaacagatatttgagaagatatgttctggcatgtacttgggagaaattttacgcagagttctacttagaatggctgaagaagctggcatttttggcgaggaagttcctccaaaactcaagaattcattcatattgaggacacctgaaatgtctgctatgcatcatgacacatcctctgatttgagagtggttggcgacaagttgaaggatatcttagagatctccaattcctccttgaagacaaggagattagttgttgagctgtgtaatattgttgcaacacgtggcgccagacttgcagcagctgggatcttgggcattatcaaaaagatgggaaaggatacacccagggaaagtggtccagaaaagattgtcgtagccatggatggcggattgtatgaacattatacagaatacagtaagtgcttggagaacactttggttgaattgcttggaaaggaaatggccacaagtattgttttcaagcacgcgaatgatggttctggcattggcgcggcactccttgcggcctctaactccgtgtatgttgaagacaagtga

SEQ ID NO: 750 - protein, 496 aa, Solanum tuberosum
MKKATVGAVVVGTAAAVAVAALIMRHRMGKSSKWARARAILKEFEEKCATPDGKLKQVADAMTVEMHAGLASEGGSKLKMLISYVDNLPTGDEGGVFYALDLGGTNFRVLRVQLGGKDGGIIHQEFAEASIPPNLMVGTSEALFDYIAAELAKFVAEEGEEFHPPPGRQRELGFTFSFPIMQTSINSGTLIRWTKGFSIDDTVGKDVVAELTKAMQKREIDMRVSALVNDTVGTLAGGRFTNKDVSIAVILGTGTNAAYVERAQAIPKWHGPLPKSGEMVINMEWGNFRSSHLPLTEYDHAMDTNSLNPGEQIFEKICSGMYLGEILRRVLLRMAEEAGIFGEEVPPKLKNSFILRTPEMSAMHHDTSSDLRVVGDKLKDILEISNSSLKTRRLVVELCNIVATRGARLAAAGILGIIKKMGKDTPRESGPEKIVVAMDGGLYEHYTEYSKCLENTLVELLGKEMATSIVFKHANDGSGIGAALLAASNSVYVEDK

SEQ ID NO: 751 - DNA, 1500 bp, Nicotiana tabacum
  CDS (1)..(1500)
atgtcggtcaccgttagctcgccggccggccgatccttccatatttcacgatcaccttacaaaaagatctccaagccacgtgtcattatcgctgccgtccgatctggtgttagtttagcggtagcaccaatattgactaagttgcagaaagactgtgcaactccacttcctgttttgcgccacgtggctgatgccatggccgttgatatgcgggctggacttgccgtcgatggtggcagtgatctgaagatgatccttagttatattgacactttaccaactgggaatgagaaaggtttgttctatgcattggaccttggtggtacaaatttccgagtgttaagagtgcagttaggtggtaaagaagagcgcgtaatcgccactgagtttgagcaagtctctatacctcaagaattgatgtttgcaacctctgaggagttgttcgatttcatagcttctgagctaggaaaattttcacaaagtgaaggcggtaagtttgagatgcaacaaggaaggactagagaaataggattcacattttctttcccagtgaagcagacttcagttaaatctggcatcctaatcaagtggacaaagggttttgcagtctctggaactgcaggaaaagatgtggttgcttgtttaaatgaagccatggaaaggcagggattgggaatgcaagtctcggccctggtcaatgacactgtagcaacacttgctggagcgagatactgggacaatgatgtcatggttgctgtcattcttgggactggaaccaatgcttgctacgtagaacgtgtggatgctattcctaaactgccacaaaggatgtccaactctccagaaacaattgtgaatactgaatggggagcattttcaaatggccttcctttaactgagtttgatagagaaatggatgccgagagcattaaccctggtgagcagatttttgagaaaacaatctctggtatgtaccttggagaaattgtaagacgggtgctggtcaaaatggccaaggttggcggcttatttggcggtggctatgttccagaaaagttagtcactccatttgtgctgaggacaccggatatatgtgcaatgcagcaggatacatccagagatcttgaagctgttgagtctgtcctctatgatatagctggggtaaaatctgatctaagtgcaaggaaaacagtcgtagacatttgcgatactattgcaaatcgaggggggcgtctagctggtgcaggaattgttgggattctccagaaaatggaagaggattcaaaaggcgtaatcttcggtaagagaacagttgtagcaatggatggaggtttatatgagcactatcctcagtacagagaatacctccaagaagctgtcacagaacttcttggatcagaaatttctaaaaatgtagtgatagagcattcaaaagatggatctggaattggagctgcattattagctgctgcaaactcaaagtatgaacatgattattag

SEQ ID NO: 752 - protein, 499 aa, Nicotiana tabacum
MSVTVSSPAGRSFHISRSPYKKISKPRVIIAAVRSGVSLAVAPILTKLQKDCATPLPVLRHVADAMAVDMRAGLAVDGGSDLKMILSYIDTLPTGNEKGLFYALDLGGTNFRVLRVQLGGKEERVIATEFEQVSIPQELMFATSEELFDFIASELGKFSQSEGGKFEMQQGRTREIGFTFSFPVKQTSVKSGILIKWTKGFAVSGTAGKDVVACLNEAMERQGLGMQVSALVNDTVATLAGARYWDNDVMVAVILGTGTNACYVERVDAIPKLPQRMSNSPETIVNTEWGAFSNGLPLTEFDREMDAESINPGEQIFEKTISGMYLGEIVRRVLVKMAKVGGLFGGGYVPEKLVTPFVLRTPDICAMQQDTSRDLEAVESVLYDIAGVKSDLSARKTVVDICDTIANRGGRLAGAGIVGILQKMEEDSKGVIFGKRTVVAMDGGLYEHYPQYREYLQEAVTELLGSEISKNVVIEHSKDGSGIGAALLAAANSKYEHDY

SEQ ID NO: 753 - DNA, 1503 bp, Oryza sativa
  CDS (1)..(1503)
atggggagggtggggctcggcgtggcggtggggtgcgcggcggtgacctgcgcgatcgccgcggcgctcgtggcgcgcagggcgtcggcgcgggcgcggtggcggcgggcggtggcgctgctgcgggagttcgaggaggggtgtgccacgccgcccgcgaggctgcgccaggtcgtggacgccatggtcgtcgagatgcacgccggcctcgcgtccgatggcggcagcaagctcaagatgctgctcaccttcgtcgacgcgctccccagcgggagtgaagaaggtgtatattattctattgatcttggaggaacaaacttcagagtcttgagggtacaagttggtgcgggatctgtgatcgtcaaccaaaaggttgaacagcaacccatccctgaggaactgaccaaaggcactactgagggtttattcaactttgttgccctggcactaaagaattttcttgaaggagaagatgaccaagatggaaaaatggcacttggttttacattttctttccctgttagacaaatttcagtgtcttcagggtcattaattaggtggacaaaaggattttccatcagagacacggttggcagagatgttgctcagtgcttaaatgaagcgcttgccaattgtgggctaaatgtgcgggtcactgcattggtgaatgatacagtggggacattagctctagggcattactatgatgaagacacagtggctgctgtgataattgggtctggcaccaacgcttgctacattgaacgcactgatgcaattatcaagtgccagggtcttctaacgaactctggaggcatggtagtaaacatggagtgggggaatttctggtcatcacatttgccaaggacgccatatgacatcttgctggatgatgaaacacacaatcgcaatgatcagggctttgagaaaatgatatcaggaatgtatcttggggaaattgcaagattggtatttcatagaatggcccaggaatcagatgtttttggtgatgctgctgatagtctatccaaccctttcattttgagcacaccgtttctggccgcaattcgcgaggacgattcaccagatctgagcgaagtcagaaggatacttcgagaacatctgaagattcccgatgctcctctgaaaactcgacggctggtcgtgaaagtctgcgacattgtgactcgcagagccgcccgtctagccgctgcaggcatcgtggggatactgaagaagctggggagggatgggagcggcgcggcgtcgagcgggagaggtagagggcagccgaggaggacggtggtggcgatcgagggcgggctgtaccagggttacccggtgttcagggagtacctggacgaggccctggtggagatcctgggggaggaggtggcgcggaacgtgacgctgagggtgacggaggatgggtcgggggtcggggctgccctcctcgccgccgtacattcgtcgaatagacagcaacaaggaggtcccatatag

SEQ ID NO: 754 - protein, 500 aa, Oryza sativa
MGRVGLGVAVGCAAVTCAIAAALVARRASARARWRRAVALLREFEEGCATPPARLRQVVDAMVVEMHAGLASDGGSKLKMLLTFVDALPSGSEEGVYYSIDLGGTNFRVLRVQVGAGSVIVNQKVEQQPIPEELTKGTTEGLFNFVALALKNFLEGEDDQDGKMALGFTFSFPVRQISVSSGSLIRWTKGFSIRDTVGRDVAQCLNEALANCGLNVRVTALVNDTVGTLALGHYYDEDTVAAVIIGSGTNACYIERTDAIIKCQGLLTNSGGMVVNMEWGNFWSSHLPRTPYDILLDDETHNRNDQGFEKMISGMYLGEIARLVFHRMAQESDVFGDAADSLSNPFILSTPFLAAIREDDSPDLSEVRRILREHLKIPDAPLKTRRLVVKVCDIVTRRAARLAAAGIVGILKKLGRDGSGAASSGRGRGQPRRTVVAIEGGLYQGYPVFREYLDEALVEILGEEVARNVTLRVTEDGSGVGAALLAAVHSSNRQQQGGPI

SEQ ID NO: 755 - DNA, 1530 bp, Oryza sativa
  CDS (1)..(1530)
atgtccgccgccgccgccatcgcgtcgccgatcccggcggcgatcgccgtcgtgcagcagcagaggcgggggaggagccgcggcggcggctccggcgctgccgccgtccgctgctccgcggtggccccgacgtccgcgatcgcgcccatccttgccgacctgaggctgcggtgcgccgccccgctccccgtgctgcggcgcgtggcggacgccatggcctccgggatgcgcgccgggctggccgacgacggcgccggcgagctcaagatgatccccagccacgtctactcactccccactgggaatgaaacaggactgttttatgctctggaccttggaggcaccaactttagagtgctgagggtacaattgggaggaaaagataagcgcattatagataccgagtttgagcaagtctcgatcccaagagaaatcatgcatggtataaccgaggatttgtttgatttcatcgcgagtggcctgtcgagatttgtagcaacggagggtgataagtttcatttgccacaagggagaaagagagagttaggcttcacattctcctttccggtgaatcagacttctattgattctggcattctgatcaagtggacaaaaggttttgctgtctctggaactgctgggaaagatgttgttgcttgtctgaatgctgcaatggagaggcaaggccttgatatgcgtgtctctgccttggtaaatgatactgtgggaaccttagctggagcacgttattgggacgatgacgtaatggtcgcggtgattttgggcactggcaccaatgcatgctacattcaacgaactgaagctattccaaaattgcaacaccttaagcttgaaacaggaaacacgattattaacactgagtggggagctttctcagatggacttccattgactgaatttgacagagaaatggatgatgagagcataaatcctggtgaacagatattcgagaagacgatttccgggatgtatctaggtgaaattgtccgtagggtgctggtcaagatggctgaagtatctgatctctttggtcattccttccccaagaaacttgctgaaccatttgttctaaggacaccacatctatgcgctatgcaacaagacacctctgacaatcttggagaagttgagtccatcttgagtgatgtcatcggcgtgtcccaagcttctctgctggcacggagagtcactgtagaagtctccgactgcatcatcaggagaggaggccggttggccggggcaggaatcgtagggatccttgagaagatggagaatgactccagagggcacattttcggacgaagaacagtggtcgcgatggacggtggtctatatgagaagtaccctcagtacaggaggtacatgaaggaggctgtggctgagctactgggacccgagcgatcgaatcgtatcgccatcgagcacacgaaagacggatcagggatcggcgctgcgctgttggcagctgcaaactcaaagtatgctgctgctcaaatctctacaaggtga

SEQ ID NO: 756 - protein, 509 aa, Oryza sativa
MSAAAAIASPIPAAIAVVQQQRRGRSRGGGSGAAAVRCSAVAPTSAIAPILADLRLRCAAPLPVLRRVADAMASGMRAGLADDGAGELKMIPSHVYSLPTGNETGLFYALDLGGTNFRVLRVQLGGKDKRIIDTEFEQVSIPREIMHGITEDLFDFIASGLSRFVATEGDKFHLPQGRKRELGFTFSFPVNQTSIDSGILIKWTKGFAVSGTAGKDVVACLNAAMERQGLDMRVSALVNDTVGTLAGARYWDDDVMVAVILGTGTNACYIQRTEAIPKLQHLKLETGNTIINTEWGAFSDGLPLTEFDREMDDESINPGEQIFEKTISGMYLGEIVRRVLVKMAEVSDLFGHSFPKKLAEPFVLRTPHLCAMQQDTSDNLGEVESILSDVIGVSQASLLARRVTVEVSDCIIRRGGRLAGAGIVGILEKMENDSRGHIFGRRTVVAMDGGLYEKYPQYRRYMKEAVAELLGPERSNRIAIEHTKDGSGIGAALLAAANSKYAAAQISTR

SEQ ID NO: 757 - DNA, 1524 bp, Oryza sativa
  CDS (1)..(1524)
atggggaaggcggcggcggtggggacggcggtggtggtggccgcggcggtcggggtggcggtggtgctggcgcggaggcggaggaggagggacctggagctggtggagggagccgcggcggagaggaagaggaaggtggcggcggtgatcgaggacgtggagcacgcgctgtcgaccccgacggcgctgctgcggggcatctcggacgccatggtcaccgagatggagcgaggcctgcgcggggacagccacgccatggttaagatgctcatcacctacgtcgacaacctccccaccggaaatgaacaggggttgttttatgcattggatcttggaggaaccaacttccgcgtcctgcgagtccaactcggtggcaaggagaaacgtgtcgtccaacaacagtacgaggaagtctcaattccaccacatctgatggttggaacttccatggaactgtttgattttattgcttctgcattgtcaaaatttgttgatactgaaggtgatgatttccacctcccagaagggagacagagagagctgggcttcaccttttccttcccagtgagccagacatcaatatcgtcaggaacgctcatcaagtggacaaagggtttctccatcaatgacgcggttggcgaagatgttgtatctgagttgggcaaggccatggagaggcagggattagatatgaaaattgcagcattggttaatgacactgtcggcacattggctggtgggaggtatgcggataacagtgttgttgctgctataatattgggcactggtacaaatgcagcatatgttgagaatgctaatgcaattcctaaatggaccggtttactgcctaggtccggaaatatggtaatcaacacagaatgggggagctttaaatcagataagcttcctctttcagaattcgataaagcaatggattttgaaagcttgaatcctggagagcagatatatgaaaagttgatttctggcatgtatcttggagagatagtgcgaagaatcttgctgaagcttgctcatgatgcagctttgtttggggatgttgttccatctaagctagagcaaccgtttgtactaaggacaccggatatgtcagccatgcatcatgactcgtcacatgaccttaaaactgttggagctaagctaaaggatatcgtcggggtcccagatacttccctggaagtaagatacattaccagtcacatttgtgacatagttgcagagcgtgctgcacgcttggctgctgctggcatatatggggtcctaaagaagctaggtcgggacaagatgccaaaagacggcagtaagatgcctaggactgtcattgccttggatggtgggctctatgaacattacaagaagttcagcagttgcttagaatcaactctaacagaccttcttggggatgatgtctcgtcttcggtggttaccaagctggccaacgatggttctggcattggagctgctcttctcgcagcctcgcactcccagtatgccgagatcgactag

SEQ ID NO: 758 - protein, 507 aa, Oryza sativa
MGKAAAVGTAVVVAAAVGVAVVLARRRRRRDLELVEGAAAERKRKVAAVIEDVEHALSTPTALLRGISDAMVTEMERGLRGDSHAMVKMLITYVDNLPTGNEQGLFYALDLGGTNFRVLRVQLGGKEKRVVQQQYEEVSIPPHLMVGTSMELFDFIASALSKFVDTEGDDFHLPEGRQRELGFTFSFPVSQTSISSGTLIKWTKGFSINDAVGEDVVSELGKAMERQGLDMKIAALVNDTVGTLAGGRYADNSVVAAIILGTGTNAAYVENANAIPKWTGLLPRSGNMVINTEWGSFKSDKLPLSEFDKAMDFESLNPGEQIYEKLISGMYLGEIVRRILLKLAHDAALFGDVVPSKLEQPFVLRTPDMSAMHHDSSHDLKTVGAKLKDIVGVPDTSLEVRYITSHICDIVAERAARLAAAGIYGVLKKLGRDKMPKDGSKMPRTVIALDGGLYEHYKKFSSCLESTLTDLLGDDVSSSVVTKLANDGSGIGAALLAASHSQYAEID

SEQ ID NO: 759 - DNA, 1521 bp, Oryza sativa
  CDS (1)..(1521)
atggggaaggggacggtagtggggacggcggtggtggtgtgcgctgcagcggccgcggcggttggggtggcggtggtggtgtcgcggaggaggaggagcaagcgggaggcggaggaggagcggcggaggagggccgccgctgtgatcgaggaggtggagcagaggttctcgacgcccacggcgctgctgcgcggcatcgcggacgccatggtggaggagatggagcgcggcctccgcgccgaccctcacgccccgctcaagatgctcatcagctacgtcgacaacctccccaccggggatgagcacggactgttctatgctctcgatcttgggggcaccaatttccgtgttatacgtgttcagcttggaggaagggaaaagcgtgttgttagtcaacagtacgaagaggttgccattccacctcacctgatggttgggacttctatggaactgtttgacttcattgcggctgagttggaaagttttgtcaagaccgagggagaggatttccacttgccagagggcaggcagagagagttaggcttcaccttttctttcccagtgcaccaaacatcaatatcatcaggcactcttattaagtggacaaagggattttccatcaatggcacggtgggggaagatgttgtggctgaattgagcagggctatggaaaggcaagggcttgatatgaaagttacagctcttgttaatgacactgtaggcacattggctggcggaagatatgttgataatgacgttgctgctgctgtaatattaggcactggcacaaacgcagcctacgtggagcatgcaaatgcaattccaaaatggactggattactacctagatcaggaaatatggtgattaacatggaatggggaaacttcaagtcagaaaggcttcctcgttcagattacgataatgccttggactttgaaagtttaaacccaggcgagcagatatatgaaaagatgatttccggcatgtatcttggagagattgtgcgcagaatcttgcttaagcttgctcatgatgcttccttgtttggagatgttgttccaacaaagctggagcagcgctttatactgaggacgccggacatgtcagcgatgcatcatgatacctcacatgatctgaaacacctgggagctaagctgaaggatatcctgggggtcgctgatacttccctggaagcacgatacatcacccttcatgtctgcgacctcgttgcagagagaggtgcacgcttagctgctgctggtatatatggcattctaaagaagctgggcagggacagagtgccaagtgacggtagtcaaaagcagaggactgtcattgctctggatggtggtctctatgagcattacaagaagttcagaacctgcctagaagcaacgcttgcagacctgcttggagaggaggctgcctcatcagttgttgtcaagttggcaaacgatggctctggcatcggagctgcacttcttgcagcatctcactcccagtatgctagcgtcgagtag

SEQ ID NO: 760 - protein, 506 aa, Oryza sativa
MGKGTVVGTAVVVCAAAAAAVGVAVVVSRRRRSKREAEEERRRRAAAVIEEVEQRFSTPTALLRGIADAMVEEMERGLRADPHAPLKMLISYVDNLPTGDEHGLFYALDLGGTNFRVIRVQLGGREKRVVSQQYEEVAIPPHLMVGTSMELFDFIAAELESFVKTEGEDFHLPEGRQRELGFTFSFPVHQTSISSGTLIKWTKGFSINGTVGEDVVAELSRAMERQGLDMKVTALVNDTVGTLAGGRYVDNDVAAAVILGTGTNAAYVEHANAIPKWTGLLPRSGNMVINMEWGNFKSERLPRSDYDNALDFESLNPGEQIYEKMISGMYLGEIVRRILLKLAHDASLFGDVVPTKLEQRFILRTPDMSAMHHDTSHDLKHLGAKLKDILGVADTSLEARYITLHVCDLVAERGARLAAAGIYGILKKLGRDRVPSDGSQKQRTVIALDGGLYEHYKKFRTCLEATLADLLGEEAASSVVVKLANDGSGIGAALLAASHSQYASVE

SEQ ID NO: 761 - DNA, 1392 bp, Oryza sativa
  CDS (1)..(1392)
atggtggcggcggcggtggcggcggcggagcaggtggtggcggcgctgcgggaggagtgcgcgacgccggcggcgcggctggatggggtggcggcggcgatggccggcgagatggcggcggggttggcggaggagggcggcagcaagatcaagatgatcgtttcctacgtcgacaacctccccaatgggaccgaagagggcttgttctacgcgctggatcttgggggaacaaacttccgagtcctgcgtgtgcagcttgctggaaaggagaaacgggtcgtgaagcgcgagtcgagggaggtctcgatccctccccatctcatgtccggcaactcctcggagctgtttggcttcatcgcttccgcgttagccaagttcgtcgctgatgaaggacataatgccgtgttcaacgacaggcaaagggaactggggttcaccttctctttccctgtgcggcaaacatcgattgcgtctgggactcttatcaagtggaccaaggcgttttctattgatgatgctgtaggtgaagatgtggtggccgaattgcagatggccatggagaagcaaggtctggacatgcgcgtttccgcattgatcaatgacactgttgggacattggcggcaggcagctactacgacgaagatattgtcgtcggtgtgatcttaggcactggctcaaacgccgcatatcttgagaaggcaaatgctatccctaagttggaaggcgagttaccaaaatcaggaaacatggttattaatacagaatggggtaacttctcctcatcctgtcttccaataacagaatatgatgaagcactagataaagagagcttaaaccctggagagcagatcttcgagaaattgatttcaggaatgtatctaggtgaaatcgtaaggagagtgcttcttaaaatatctttgcagtcttcaatttttggcaatctagatcagaccaagctcaaaacccgctttattctgaggactcctgatatttccgtgatgcatcatgatggaacacctgatctcagaattgtggctgaaaaacttgcagataacctgaagatcacagacacatccttagaaacaaggaagatggttgtcgaaatctgtgacatcgtcacccgaagatcagcccggctggctgctgctgggatcgtagggatcctcaggaagatcggcagaggcgtcccaggcgacaagcgaaagtcggtcatcgccatcgatggcggtctatatgaacattacaccgaattccggcagtgcctggagaccacgctgacggagttgctcggagaagaggcgtcgaagtcggtggctgtcaagcttgcaaacgacgggtctggccttggagctgccctgattgcagctgctcattctcagtacctgaattga

SEQ ID NO: 762 - protein, 463 aa, Oryza sativa
MVAAAVAAAEQVVAALREECATPAARLDGVAAAMAGEMAAGLAEEGGSKIKMIVSYVDNLPNGTEEGLFYALDLGGTNFRVLRVQLAGKEKRVVKRESREVSIPPHLMSGNSSELFGFIASALAKFVADEGHNAVFNDRQRELGFTFSFPVRQTSIASGTLIKWTKAFSIDDAVGEDVVAELQMAMEKQGLDMRVSALINDTVGTLAAGSYYDEDIVVGVILGTGSNAAYLEKANAIPKLEGELPKSGNMVINTEWGNFSSSCLPITEYDEALDKESLNPGEQIFEKLISGMYLGEIVRRVLLKISLQSSIFGNLDQTKLKTRFILRTPDISVMHHDGTPDLRIVAEKLADNLKITDTSLETRKMVVEICDIVTRRSARLAAAGIVGILRKIGRGVPGDKRKSVIAIDGGLYEHYTEFRQCLETTLTELLGEEASKSVAVKLANDGSGLGAALIAAAHSQYLN

SEQ ID NO: 763 - DNA, 1377 bp, Oryza sativa
  CDS (1)..(1377)
atggcggcggtggaggcggagaaggtggtggcggagctgcgggagaggtgcgcgacgccggcgtcgctgctgcgggatgtggcggcggcgatggccggcgagatgggcgccggcctggagaaggagggtgggagcagggtcaagatgctgctctcctacgtcgacaagctccccactgggagagaggatggattgttctatggattggacctaggaggaacaaacttccgggtgctcaaggttcatcttggtggcagcaagaagcatgtcgtcaactctgaatccagggaagtcagcatcccaccacacctgatgtcagggacctcctcggaattgtttggtttcattgctggggaattaggcaagtttgttgctgaagaggaggagggtactgacatgccaaacggcaagaagaaagagctaggattcaccttctcttttcctgtgaggcaacgatctgtggcatcgggtacccttgtcaagtggacaaaggcgttttccattgatgatgcagtaggtgaagatgtggtggctgaactacaaacggctatggtgaaacaaggtctggacatgcatgtagctgcattgattaatgatgctgttggaacattggctggagcaagatactacgatgaagatgttgtcgcaggtgtgatatttggtactggcacaaatgctgcatatgttgagaaggcaaatgctataccaaaatgggaaggggagttgcccaattcaggggatatggtcatcaatatggaatggggtaatttctattcatcgcatcttccagttactgaatacgatgaagcattagacaaggaaagcttaaaccctggagagcagatatatgagaagttaacatcaggaatgtatttaggtgaaatcgtaagaagagtgctgcttaaactgtccttgcagtctggaattttcggttctatagataactccaagctcaaaacttgtttccatctgcggactccgcacatttctgcaatgcaccatgatgaaacacctgacctaaagatagtggctgaaaaattgcatcaaatcctagagattacacatacatccttagagataaggaaaatggttgtcgaaatatgcgatatcgtggcaaggagggcagctcggctggctgctgctggtgttgcagggatcctcatgaagcttggaagaaatggcggcatcaacaatcagcgctcggtcatcgccattgatggaggtttgttcgaacactacaccaaattcagggaatgtttggagagcacgttgggtgagttgctgggagaggaggcttccaagtcggtagccgtcaagcacgcgaacgacgggtcagggataggggctgcccttattgcagcctctcaatctcgatga

SEQ ID NO: 764 - protein, 458 aa, Oryza sativa
MAAVEAEKVVAELRERCATPASLLRDVAAAMAGEMGAGLEKEGGSRVKMLLSYVDKLPTGREDGLFYGLDLGGTNFRVLKVHLGGSKKHVVNSESREVSIPPHLMSGTSSELFGFIAGELGKFVAEEEEGTDMPNGKKKELGFTFSFPVRQRSVASGTLVKWTKAFSIDDAVGEDVVAELQTAMVKQGLDMHVAALINDAVGTLAGARYYDEDVVAGVIFGTGTNAAYVEKANAIPKWEGELPNSGDMVINMEWGNFYSSHLPVTEYDEALDKESLNPGEQIYEKLTSGMYLGEIVRRVLLKLSLQSGIFGSIDNSKLKTCFHLRTPHISAMHHDETPDLKIVAEKLHQILEITHTSLEIRKMVVEICDIVARRAARLAAAGVAGILMKLGRNGGINNQRSVIAIDGGLFEHYTKFRECLESTLGELLGEEASKSVAVKHANDGSGIGAALIAASQSR

SEQ ID NO: 765 - DNA, 1509 bp, Oryza sativa
  CDS (1)..(1509)
atgaggaaggcggcggcgctggcgtccgcggcgatggccgcagcagcagtagcggtagtctccacggtgttgcaccagaggcaacgtcgggcggcgaagcggtcagagcgcgcggaggccgtgctgctgcgggacctgcaggagcggtgcgccgcgccggtggagctgctgcggcaggtggcggacgcgatggccgcggagatgcgcgcggggctcgccgccgagggcgggagcgacctccagatgctcgtcacctacgttgactccctcccctccgggggtgagaaagggatgttttatgcacttgaccttggaggaacaaatttccgtgttttacgagttcaattaggaggcaaagaacgtcgaattatcaagcaagactcagaagggatatccattccacaacatttaatgtccagcagttcacatgagttgtttgattttgttgctgtggctttagcaaaatttgttgcctctgaaggtgaagactgccatcttcctgagggtacccaaagagaactaggttttacattctcctttccagtgaaacaaaaatcattggcatctggcactcttatcaagtggacgaagagttttgcaattgatgaaatggtcggcaaggatgttgtggctgaattaaacatggctatcagaagtcaaggacttgatatgaaagtcacagcattggttaatgatacagtagggacattagctgctgggagatatgtgaatcatgatactattgctgctgttatactgggaacaggtagtaatgcagcgtacatagatcatgcagatgcaattccaaaatggcatggatccctgcccaagtctggaaatatggtaataaacatggaatggggtaactttaagtcctcacatcttccacttactgaatttgatcaagagttggatgcagaaagtttgaaccctggcaaacaggtttacgagaaatcgatttctggtatgtatatgggggaacttgttcgaagaatcttactaaagatggctcaagaaactcgcatttttggtgataatatacctccaaaacttgagagaccatacatcttaaggacacttgacatgctgatcatgcatcatgatacatcatctgatctcagaacagttgccaacaagttgaaagaagtcttggggatcgaatatacctctttcacgacgaggaaactggttttggatgtttgtgaggccattgcgacacgcggtgcacggcttgctgctgctgggatatatggcattatccaaaagcttggtcagcattctgacagccccagtacgagaaggtccgtgattgctgtggatggaggggtctataaatactacactttcttcagccagtgcatggagagcactctgagtgacatgcttgggcaggagctggccccctctgttatgatcaagcatgtcaatgatggctcaggcgttggggcagctctcctggcagcctcttattctcaataccaccaggctgaatctgcagatagttcataa

SEQ ID NO: 766 - protein, 502 aa, Oryza sativa
MRKAAALASAAMAAAAVAVVSTVLHQRQRRAAKRSERAEAVLLRDLQERCAAPVELLRQVADAMAAEMRAGLAAEGGSDLQMLVTYVDSLPSGGEKGMFYALDLGGTNFRVLRVQLGGKERRIIKQDSEGISIPQHLMSSSSHELFDFVAVALAKFVASEGEDCHLPEGTQRELGFTFSFPVKQKSLASGTLIKWTKSFAIDEMVGKDVVAELNMAIRSQGLDMKVTALVNDTVGTLAAGRYVNHDTIAAVILGTGSNAAYIDHADAIPKWHGSLPKSGNMVINMEWGNFKSSHLPLTEFDQELDAESLNPGKQVYEKSISGMYMGELVRRILLKMAQETRIFGDNIPPKLERPYILRTLDMLIMHHDTSSDLRTVANKLKEVLGIEYTSFTTRKLVLDVCEAIATRGARLAAAGIYGIIQKLGQHSDSPSTRRSVIAVDGGVYKYYTFFSQCMESTLSDMLGQELAPSVMIKHVNDGSGVGAALLAASYSQYHQAESADSS

SEQ ID NO: 767 - DNA, 1844 bp, Brassica napus
  CDS (123)..(1628)
ccaccacgagctcgagtagatcgatctagggttcccattaatttcggtatttttagatccaacccaatcctataatagatcctttttgacctttgtcctttttgtcttacagatcgaatcttatgggtaaagtggctgttggtgcgacggtcgtgtgcgctgcggcggtctgcgcggcgtctgtgtacatcgtgcggcggcggatgcaaagctccgggaaatgggcgcgtgtgatagagatcctgagggttctcgaggaggattgcgcgacgcctatcgcgaaactgagacaagtggcggatgcgatgacggttgagatgcacgcgggtctcgcttccgaaggtggaagcaagcttaagatgcttatcagctacgtcgataatcttccctctggggaagaacatggtttcttctatgcgctggacctaggaggaacgaacttccgtgtgatgcgtgtgcttcttggtggcaaacaaggccgtgttgtcaaacaagaagccaaagaagtctctattcctcctcatttgatgaccagcggttcagatgaactgttcaattttatcgctgaggcgcttgcaaatttcgtggctacagaaggagaggactttcatctccctgagggtagacaaagggagctaggtttcactttctcgtttccggttaagcagacttctttgtcttctggcactctcatcaagtggaccaaaggcttttccatcgaagatacagttggacaagatgtggttggtgagcttgttaaagctatggaaagagttgggcttgacatgaacgtcacagcccttgttaatgacacggttggaacacttgctggtggtagatactataaccctgatgtggttgccgctgttatcttaggcactggcacaaacgcagcttatgtggaacgtgcacatgccattcccaaatggcacggcttacttcccaaatctggagaaatggtgatcaacatggagtggggaaacttcaggtcatcacatcttcccttgacggagtacgaccacttgctggatttcgatagtctgaatcctggtgaacagattcttgagaaaatcatttccggtatgtatttgggagagatcttgcgtagagttcttctgaagatggctgaagaggctgctttctttggcgactccatcccacctaagctgaaagtaccattcatcataaggactccgaccatgtctgctatgcacagcgacacttctccggatttgaaggttgttggaagcaagttaaaggacatactggaggtccctactactctgaagatgagaaaagttgtgatcagtctctgtaacatcatcgccacccgaggagctcgtctctctgcagctgggatctacggaatcctcaagaaactaggaagagacgcaccgaaagatggagaaacaacgcagaaatctgtgattgccatggacggtggactgttcgagcactacactcagttcagtgagtgtatggagagctcattgaaagagttgcttggagatgaagcatcagagagcgtcgaggtgattcattcgaatgacgggtccggcgttggcgctgcattgctcgctgcctcgcactttcagtacctcgaggactttgaaacaagtttaatttaaaagaaggtttcggcttcccagcatggaaggtaaaaagacctttgtgattttttgtttgcccattattgaggtttttctttttttttttgttatcattgttcaggaacaataataaacaaccaacctggatatcttcttcaggttatggcaaattcaaaaacaagccaatgttgtagaactatatatttcatagttctatatacgggatcgtcgacc

SEQ ID NO: 768 - protein, 501 aa, Brassica napus
MGKVAVGATVVCAAAVCAASVYIVRRRMQSSGKWARVIEILRVLEEDCATPIAKLRQVADAMTVEMHAGLASEGGSKLKMLISYVDNLPSGEEHGFFYALDLGGTNFRVMRVLLGGKQGRVVKQEAKEVSIPPHLMTSGSDELFNFIAEALANFVATEGEDFHLPEGRQRELGFTFSFPVKQTSLSSGTLIKWTKGFSIEDTVGQDVVGELVKAMERVGLDMNVTALVNDTVGTLAGGRYYNPDVVAAVILGTGTNAAYVERAHAIPKWHGLLPKSGEMVINMEWGNFRSSHLPLTEYDHLLDFDSLNPGEQILEKIISGMYLGEILRRVLLKMAEEAAFFGDSIPPKLKVPFIIRTPTMSAMHSDTSPDLKVVGSKLKDILEVPTTLKMRKVVISLCNIIATRGARLSAAGIYGILKKLGRDAPKDGETTQKSVIAMDGGLFEHYTQFSECMESSLKELLGDEASESVEVIHSNDGSGVGAALLAASHFQYLEDFETSLI

SEQ ID NO: 769 - DNA, 2087 bp, Glycine max
  CDS (179)..(1669)
gtgtcggtctcgccactgtcactttctttctctcacaaatcacaatgtgctccgataactacaatctctcaattccccattaattaaaatcaaaatcaaaatctaatctgggtttctcccatcagaggacaaagcttccgactttgcgggattcgttcgtatttgtttcagtgctgtgatggggaaggtcgcggtgggagctgccgttgtctgcgccgccgccgtatgcgctgcggcggcgctggtggtgcgccaccgcatgattagttcccggaagtggagtcgcgccatggcgatactgaaggagtttgaggagaagtgtggcaccccaattgtgaagctaagacaagtggctgatgccatggatgttgagatgcacgcgggtctcgcatctgaaggtggtagcaagctcaatatgttgatcagttttgtcgataatctcccaactggggatgaggaaggcctctattatgcactggatcttggaggcacaaacttccgtgtccttcgtgtacatttaagcgggaaagacaaaggtgttatcggccaggagtttgaagaagtttcaattcctccaaatttgatgactggctcttcagaagcattgtttgattttatagcagcagctcttgcaaagtttgttggttcagaacctgaaggttttcatcctccccctggcagacaaagagaactgggttttacattctcattcccagtgaggcaaacatcgattgcatctgggactctaataaagtggactaaaggtttcaatattgaagatgtggttggtgaagatgtggtgggagaactaaccaagtccatggaaaaaattggcctggatatgcgcgttgctgctctagttaatgataccattggaacattagctggaggcagattctacaatcaggatgtcattgctgctgtgattcttggtactgggacaaatgcagcatatgtagaacgtgcacatgctattccaaaatggcatggtcttctaccaaaatcaggagatatggttataaacatggagtggggtaatttccgatcatcacatcttcctctaacagaatatgatctagctctagatgctcagagcttaaaccctggagaacagatttttgagaagataatttctggtatgtatttgggtgaaattgtaaggagagttttgttgaagatggcggaagaagttgacttctttggagatactgttcctccaaaattgagaattcctttcgtacttaggacacctgacatgtctgcaatgcatcatgatacatcttcagatctgaaggtggttggaaacaaattgaaggatatattagagatcaataacacatccctgaaaatgaggaagattgttgtggaactctgtgatattgttgctaatcggggagcccgcctttctgctgctggtatttttggcatcctcaagaaaataggaagagacacagtaaaggacgggaagaaatcagtagtagcactggatggaggattgtttgaacactatactaaattcagaagttccttggagagtacactaaaggagttgttgggagatgaggcagctgagacaattggcattgagcagtctaatgatggctctggaattggagcagccctcctggcagcttctcactcccagtatttggaagtgcaggagtcctgaagatgtggtttaatgtcaaggtaaatcagtgtaacactagtttcatttttttgtatacctactagatcaacagattgaagcagaaaagtcttcgttactagtcctagagagcttttaaccaggaaggtggaccaagtccacagtggagttatttgtagggctgtgttcttcttgctgcaaatgcaacattgctgcttctcggctaattactggtgcattgttttggttacagtgtttgtctctcccacatcaaagaataataggagagatgtaaacttttgagttgtctcgttttcccaatgtaacatgttttcaatgagaataagtcaggattaatttattgacaaaggtgaatgatttcaattcaaggcttttgaaaaaaaaaaaaaaaaaaaaaaaaaaaaaaaaaaaaaaaaga

SEQ ID NO: 770 - protein, 496 aa, Glycine max
MGKVAVGAAVVCAAAVCAAAALVVRHRMISSRKWSRAMAILKEFEEKCGTPIVKLRQVADAMDVEMHAGLASEGGSKLNMLISFVDNLPTGDEEGLYYALDLGGTNFRVLRVHLSGKDKGVIGQEFEEVSIPPNLMTGSSEALFDFIAAALAKFVGSEPEGFHPPPGRQRELGFTFSFPVRQTSIASGTLIKWTKGFNIEDVVGEDVVGELTKSMEKIGLDMRVAALVNDTIGTLAGGRFYNQDVIAAVILGTGTNAAYVERAHAIPKWHGLLPKSGDMVINMEWGNFRSSHLPLTEYDLALDAQSLNPGEQIFEKIISGMYLGEIVRRVLLKMAEEVDFFGDTVPPKLRIPFVLRTPDMSAMHHDTSSDLKVVGNKLKDILEINNTSLKMRKIVVELCDIVANRGARLSAAGIFGILKKIGRDTVKDGKKSVVALDGGLFEHYTKFRSSLESTLKELLGDEAAETIGIEQSNDGSGIGAALLAASHSQYLEVQES

SEQ ID NO: 771 - protein, 488 aa, Artificial sequence
  Description of artificial sequence: consensus sequence
  Variant (2)..(2): Xaa in position 2 is any amino acid
  Variant (5)..(6): Xaa in position 5 to 6 is any amino acid
  Variant (7)..(7): Xaa in position 7 is any or no amino acid
  Variant (9)..(10): Xaa in position 9 to 10 is any amino acid
  Variant (12)..(13): Xaa in position 12 to 13 is any amino acid
  Variant (16)..(17): Xaa in position 16 to 17 is any amino acid
  Variant (20)..(20): Xaa in position 20 is any amino acid
  Variant (24)..(26): Xaa in position 24 to 26 is any amino acid
  Variant (27)..(29): Xaa in position 27 to 29 is any or no amino acid
  Variant (31)..(33): Xaa in position 31 to 33 is any amino acid
  Variant (34)..(37): Xaa in position 34 to 37 is any or no amino acid
  Variant (42)..(44): Xaa in position 42 to 44 is any amino acid
  Variant (47)..(47): Xaa in position 47 is any amino acid
  Variant (50)..(50): Xaa in position 50 is any amino acid
  Variant (52)..(52): Xaa in position 52 is any amino acid
  Variant (53)..(59): Xaa in position 53 to 59 is any or no amino acid
  Variant (61)..(61): Xaa in position 61 is any amino acid
  Variant (63)..(63): Xaa in position 63 is any amino acid
  Variant (77)..(77): Xaa in position 77 is any amino acid
  Variant (80)..(80): Xaa in position 80 is any amino acid
  Variant (84)..(94): Xaa in position 84 to 94 is any amino acid
  Variant (95)..(96): Xaa in position 95 to 96 is any or no amino acid
  Variant (100)..(101): Xaa in position 100 to 101 is any amino acid
  Variant (104)..(106): Xaa in position 104 to 106 is any amino acid
  Variant (108)..(109): Xaa in position 108 to 109 is any amino acid
  Variant (110)..(112): Xaa in position 110 to 112 is any or no amino acid
  Variant (115)..(116): Xaa in position 115 to 116 is any amino acid
  Variant (119)..(120): Xaa in position 119 to 120 is any amino acid
  Variant (122)..(123): Xaa in position 122 to 123 is any amino acid
  Variant (125)..(127): Xaa in position 125 to 127 is any amino acid
  Variant (129)..(131): Xaa in position 129 to 131 is any amino acid
  Variant (132)..(139): Xaa in position 132 to 139 is any or no amino acid
  Variant (141)..(142): Xaa in position 141 to 142 is any amino acid
  Variant (154)..(154): Xaa in position 154 is any amino acid
  Variant (156)..(156): Xaa in position 156 is any amino acid
  Variant (158)..(159): Xaa in position 158 to 159 is any amino acid
  Variant (162)..(162): Xaa in position 162 is any amino acid
  Variant (165)..(165): Xaa in position 165 is any amino acid
  Variant (171)..(171): Xaa in position 171 is any amino acid
  Variant (173)..(175): Xaa in position 173 to 175 is any amino acid
  Variant (178)..(178): Xaa in position 178 is any amino acid
  Variant (182)..(183): Xaa in position 182 to 183 is any amino acid
  Variant (185)..(186): Xaa in position 185 to 186 is any amino acid
  Variant (188)..(191): Xaa in position 188 to 191 is any amino acid
  Variant (193)..(193): Xaa in position 193 is any amino acid
  Variant (196)..(196): Xaa in position 196 is any amino acid
  Variant (198)..(198): Xaa in position 198 is any amino acid
  Variant (210)..(210): Xaa in position 210 is any amino acid
  Variant (212)..(212): Xaa in position 212 is any amino acid
  Variant (214)..(216): Xaa in position 214 to 216 is any amino acid
  Variant (217)..(217): Xaa in position 217 is any or no amino acid
  Variant (219)..(221): Xaa in position 219 to 221 is any amino acid
  Variant (225)..(225): Xaa in position 225 is any amino acid
  Variant (232)..(232): Xaa in position 232 is any amino acid
  Variant (234)..(234): Xaa in position 234 is any amino acid
  Variant (236)..(238): Xaa in position 236 to 238 is any amino acid
  Variant (241)..(241): Xaa in position 241 is any amino acid
  Variant (242)..(243): Xaa in position 242 to 243 is any or no amino acid
  Variant (245)..(246): Xaa in position 245 to 246 is any amino acid
  Variant (248)..(251): Xaa in position 248 to 251 is any amino acid
  Variant (252)..(252): Xaa in position 252 is any or no amino acid
  Variant (255)..(255): Xaa in position 255 is any amino acid
  Variant (258)..(258): Xaa in position 258 is any amino acid
  Variant (260)..(260): Xaa in position 260 is any amino acid
  Variant (264)..(264): Xaa in position 264 is any amino acid
  Variant (266)..(266): Xaa in position 266 is any amino acid
  Variant (268)..(268): Xaa in position 268 is any amino acid
  Variant (269)..(269): Xaa in position 269 is any or no amino acid
  Variant (272)..(272): Xaa in position 272 is any amino acid
  Variant (274)..(275): Xaa in position 274 to 275 is any amino acid
  Variant (277)..(279): Xaa in position 277 to 279 is any amino acid
  Variant (281)..(282): Xaa in position 281 to 282 is any amino acid
  Variant (284)..(284): Xaa in position 284 is any amino acid
  Variant (288)..(288): Xaa in position 288 is any amino acid
  Variant (290)..(291): Xaa in position 290 to 291 is any amino acid
  Variant (294)..(295): Xaa in position 294 to 295 is any amino acid
  Variant (304)..(304): Xaa in position 304 is any amino acid
  Variant (309)..(317): Xaa in position 309 to 317 is any amino acid
  Variant (318)..(318): Xaa in position 318 is any or no amino acid
  Variant (321)..(324): Xaa in position 321 to 324 is any amino acid
  Variant (325)..(327): Xaa in position 325 to 327 is any or no amino acid
  Variant (329)..(331): Xaa in position 329 to 331 is any amino acid
  Variant (333)..(333): Xaa in position 333 is any amino acid
  Variant (338)..(340): Xaa in position 338 to 340 is any amino acid
  Variant (344)..(344): Xaa in position 344 is any amino acid
  Variant (346)..(346): Xaa in position 346 is any amino acid
  Variant (348)..(348): Xaa in position 348 is any amino acid
  Variant (351)..(352): Xaa in position 351 to 352 is any amino acid
  Variant (354)..(356): Xaa in position 354 to 356 is any amino acid
  Variant (358)..(366): Xaa in position 358 to 366 is any amino acid
  Variant (367)..(375): Xaa in position 367 to 375 is any or no amino acid
  Variant (377)..(378): Xaa in position 377 to 378 is any amino acid
  Variant (380)..(385): Xaa in position 380 to 385 is any amino acid
  Variant (387)..(391): Xaa in position 387 to 391 is any amino acid
  Variant (393)..(393): Xaa in position 393 is any amino acid
  Variant (397)..(397): Xaa in position 397 is any amino acid
  Variant (401)..(402): Xaa in position 401 to 402 is any amino acid
  Variant (406)..(406): Xaa in position 406 is any amino acid
  Variant (408)..(408): Xaa in position 408 is any amino acid
  Variant (410)..(410): Xaa in position 410 is any amino acid
  Variant (412)..(419): Xaa in position 412 to 419 is any amino acid
  Variant (420)..(432): Xaa in position 420 to 432 is any or no amino acid
  Variant (434)..(434): Xaa in position 434 is any amino acid
  Variant (436)..(436): Xaa in position 436 is any amino acid
  Variant (441)..(441): Xaa in position 441 is any amino acid
  Variant (443)..(443): Xaa in position 443 is any amino acid
  Variant (445)..(457): Xaa in position 445 to 457 is any amino acid
  Variant (461)..(472): Xaa in position 461 to 472 is any amino acid
  Variant (473)..(473): Xaa in position 473 is any or no amino acid
  Variant (478)..(478): Xaa in position 478 is any amino acid
  Variant (486)..(487): Xaa in position 486 to 487 is any amino acid
CXTPXXXLXXVXXAMXXEMXAGLXXXXXXGXXXXXXXLKMLXXXVDXLPXGXXXXXXXXEXGXFYALDLGGTNFRVXRVXLGGXXXXXXXXXXXXXSIPXXLMXXXSXXXXXLFXXIAXXLXXFXXXEXXXXXXXXXXXGXXRELGFTFSFPVXQXSXXSGXLIXWTKGFXIXXXVGXDVVXXLXXAXXXXGXDMXVXALVNDTVGTLAXGXYXXXXDXXXAVIXGTGTNAXYXEXXXAIXXXKXXGXXXXXSGXMVXNXEWGXFXSXXLPXTXXDXXXDXXSXNPGXQXXEKXXSGMYLGEIXRRVLXXXXXXXXXXFGXXXXXXXLXXXFXLRTPXXXAMHXDXSXDLXXVXXXLXXXXXXXXXXXXXXXXXXLXXRXXXXXXCXXXXXRXARLXAAGXXGILXKXGXDXXXXXXXXXXXXXXXXXXXXXVXAXDGGLXEXYXXXXXXXXXXXXXLLGXXXXXXXXXXXXXDGSGXGAALLAAXXS

SEQ ID NO: 772 - protein, 41 aa, Artificial sequence
  Description of artificial sequence: amino acid sequence pattern comprised in a variant of SEQ ID NO: 658
  Variant (3)..(3): Xaa in position 3 is any amino acid
  Variant (4)..(4): Xaa in position 4 is Ser or Thr
  Variant (5)..(6): Xaa in position 5 to 6 is any amino acid
  Variant (8)..(9): Xaa in position 8 to 9 is any amino acid
  Variant (10)..(10): Xaa in position 10 is Leu, Met or Val
  Variant (12)..(12): Xaa in position 12 is any amino acid
  Variant (13)..(13): Xaa in position 13 is Ala, Asp, Glu, Asn, Gln or Thr
  Variant (15)..(15): Xaa in position 15 is Ile, Leu or Val
  Variant (19)..(19): Xaa in position 19 is Asp, Glu or Lys
  Variant (20)..(22): Xaa in position 20 to 22 is any amino acid
  Variant (25)..(26): Xaa in position 25 to 26 is any amino acid
  Variant (31)..(31): Xaa in position 31 is Leu or Met
  Variant (34)..(34): Xaa in position 34 is Ile or Leu
  Variant (35)..(35): Xaa in position 35 is Leu or Val
  Variant (37)..(37): Xaa in position 37 is any amino acid
  Variant (38)..(38): Xaa in position 38 is Ile or Val
  Variant (40)..(40): Xaa in position 40 is any amino acid
  Variant (41)..(41): Xaa in position 41 is Glu, His, Lys or Arg
LPXXXXDXXXDXXSXNPGXXXXEKXXSGMYXGEXXRXXLXX

SEQ ID NO: 773 - protein, 20 aa, Artificial sequence
  Description of artificial sequence: amino acid sequence pattern comprised in a variant of SEQ ID NO: 658
  Variant (3)..(3): Xaa in position 3 is Phe or Leu
  Variant (7)..(7): Xaa in position 7 is Ser or Thr
  Variant (10)..(16): Xaa in position 10 to 16 is any or no amino acid
  Variant (18)..(18): Xaa in position 18 is any amino acid
  Variant (19)..(19): Xaa in position 19 is Ala, Ile, Pro or Val
  Variant (20)..(20): Xaa in position 20 is Glu or Lys
VIXGTGXNAXXXXXXXAXXX

SEQ ID NO: 774 - protein, 24 aa, Artificial sequence
  Description of artificial sequence: amino acid sequence pattern comprised in a variant of SEQ ID NO: 658
  Variant (2)..(2): Xaa in position 2 is any amino acid
  Variant (4)..(4): Xaa in position 4 is any amino acid
  Variant (5)..(5): Xaa in position 5 is Phe or Tyr
  Variant (7)..(7): Xaa in position 7 is Ala or Gly
  Variant (18)..(21): Xaa in position 18 to 21 is any or no amino acid
  Variant (23)..(23): Xaa in position 23 is any amino acid
  Variant (24)..(24): Xaa in position 24 is Gly, Ile or Val
EXGXXYXLDLGGTNFRVXXXXLXX

SEQ ID NO: 775 - protein, 28 aa, Artificial sequence
  Description of artificial sequence: amino acid sequence pattern comprised in a variant of SEQ ID NO: 658
  Variant (2)..(2): Xaa in position 2 is Ile or Val
  Variant (4)..(4): Xaa in position 4 is Ile, Leu, Met or Val
  Variant (7)..(7): Xaa in position 7 is Ala or Gly
  Variant (9)..(9): Xaa in position 9 is Phe or Tyr
  Variant (11)..(11): Xaa in position 11 is any amino acid
  Variant (12)..(14): Xaa in position 12 to 14 is any or no amino acid
  Variant (16)..(17): Xaa in position 16 to 17 is any amino acid
  Variant (18)..(18): Xaa in position 18 is Phe or Tyr
  Variant (19)..(23): Xaa in position 19 to 23 is any amino acid
  Variant (24)..(24): Xaa in position 24 is Ala, Asp, Glu, Gly, Asn, Gln, Ser or Thr
  Variant (25)..(25): Xaa in position 25 is Ala, Glu, Ser or Thr
  Variant (26)..(26): Xaa in position 26 is Ile, Leu, Met or Val
  Variant (27)..(27): Xaa in position 27 is any amino acid
  Variant (28)..(28): Xaa in position 28 is Asp, Glu or Gly
VXAXDGXLXEXXXXYXXXXXXXXXXXXX

SEQ ID NO: 776 - protein, 20 aa, Artificial sequence
  Description of artificial sequence: amino acid sequence pattern comprised in a variant of SEQ ID NO: 658
  Variant (2)..(2): Xaa in position 2 is any amino acid
  Variant (4)..(4): Xaa in position 4 is Ile, Met or Val
  Variant (5)..(5): Xaa in position 5 is any amino acid
  Variant (6)..(6): Xaa in position 6 is Ile or Val
  Variant (7)..(7): Xaa in position 7 is Ala, Ser or Thr
  Variant (8)..(8): Xaa in position 8 is Ala or Val
  Variant (10)..(10): Xaa in position 10 is Ile or Val
  Variant (13)..(13): Xaa in position 13 is Ala, Gly or Thr
  Variant (14)..(14): Xaa in position 14 is Ile or Val
  Variant (15)..(15): Xaa in position 15 is Ala or Gly
  Variant (16)..(16): Xaa in position 16 is Ala or Thr
  Variant (18)..(18): Xaa in position 18 is any amino acid
  Variant (19)..(19): Xaa in position 19 is any or no amino acid
GXDXXXXXLXNDXXXXLXXG

SEQ ID NO: 777 - protein, 13 aa, Artificial sequence
  Description of artificial sequence: amino acid sequence pattern comprised in a variant of SEQ ID NO: 658
  Variant (2)..(2): Xaa in position 2 is Ala or Val
  Variant (3)..(3): Xaa in position 3 is Ala, Asp, Asn or Val
  Variant (4)..(4): Xaa in position 4 is Ala, Glu, Asn or Ser
  Variant (5)..(5): Xaa in position 5 is Ile, Leu or Met
  Variant (6)..(7): Xaa in position 6 to 7 is any amino acid
  Variant (8)..(8): Xaa in position 8 is Asp, Glu or Gly
  Variant (10)..(10): Xaa in position 10 is any amino acid
  Variant (11)..(11): Xaa in position 11 is Ala or Asp
VXXXXXXXMXXGL

SEQ ID NO: 778 - DNA, 1983 bp, Brassica napus
  CDS (100)..(1815)
atccccctctctctctctctcttaaatatcagttttaacagaaaacctcattctcattctctctcctctgcttgacctctgttcttcaagttgtacgacatggcggcgacaggtcaaatctcgacgagaatgacggtggatcgcactctgtcctcctccaggaacgctggactttccctttcaccatcaccccagagaacgctaatcggcgtcgccggtaggtctggtatcgctcaccgtcaactgtctctctccgtcagagcgattaacaccaatgaagatagccggaaagtcaaggtttatgcagagaacggcgctttcgatttgggagtgatggatccttcagtggagccatataaatttgcggagccaagaacaagtcataatgattcgaggaggaaaaccaagattgtgtgtaccattggaccttcctctagctctcgtgaaatgatttggaaactcgcggaagcaggaatgaatgtggctcgtttgaatatgtctcatggagatcatgcttctcatcagattactattgatcttgttaaagaatacaactctctctttgttgacaaagccattgctatcatgttggatacaaagggtcctgaggttcgaagtggggatgtacctcagccgatcttccttgaagagggtcaagagtttaattttaccatcaagagaggtgtctcaatgaaagacaccgtcagtgtcaactatgatgattttgttaacgatgtcgaagttggagacatacttttggtcgatggtggaatgatgtcactagctgttaagtccaagacgagcgatttggtgaaatgtgtagttattgacggtggagagcttcaatctagacgtcacttgaatgttcgaggaaagagtgctactcttccttccataacagacaaagattgggaagacatcaaatttggagtggacaaccaagttgatttctatgctgtctcttttgttaaggatgctaaagttgtccatgagttgaaaaactacctcaaaagctgcagtgcggatatctctgtgattgtgaaaattgaaagcgcagattctataaagaatcttccttccattatatctgcttgtgatggggcaatggttgctcgtggagatcttggagctgaacttcccattgaggaggttcccttgttacaggaggagataatcacaaggtgtaggaacattcataaaccagtgattgtcgccacaaacatgctagagagtatgattaatcatccaacacctacaagagctgaagtatctgacattgcaattgcagtgcgcgaaggagcagatgcaatcatgctttctggtgaaaccgcacacggaaagtttcctctgaaagctgttaacgtgatgcataccgtggctttgagaactgaggctagtctacctgttagaacctcagcaatccggaccactgcttacaagggtcgcatgggccaaatgtttgctttccatgcttctataatggcgaatacactgaacacaccgatcattgtgttcacaagaactggatccatggcagtgcttctgagtcactaccgcccgtcctcaacaattttcgccttcacaaaccagaggagaataatgcaaaggctggctctttaccaaggtgtcatgcctatatacatggagttttctgatgatgcagaagatacatatgcccgttccttgaaactcctacaggacgagaatatgcttaaggaaggacaacatgtaactcttgtccaaagtggtgcgcaacccatttggcgtgaagaatcaacacatctcatacaagtccgtaagattaagataggttgatgtttttcactactcgagcttctatatccctgactttatttttcttacacgatttgatccaatattgttttatgtcactcacagtgaaaccatatatatttgttttaagttcttgaaccacatgactgtaaaaacaaaacagtcttttcgatgaaaaaaaaaaaaaaa

SEQ ID NO: 779 - protein, 571 aa, Brassica napus
MAATGQISTRMTVDRTLSSSRNAGLSLSPSPQRTLIGVAGRSGIAHRQLSLSVRAINTNEDSRKVKVYAENGAFDLGVMDPSVEPYKFAEPRTSHNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSMKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKSCSADISVIVKIESADSIKNLPSIISACDGAMVARGDLGAELPIEEVPLLQEEIITRCRNIHKPVIVATNMLESMINHPTPTRAEVSDIAIAVREGADAIMLSGETAHGKFPLKAVNVMHTVALRTEASLPVRTSAIRTTAYKGRMGQMFAFHASIMANTLNTPIIVFTRTGSMAVLLSHYRPSSTIFAFTNQRRIMQRLALYQGVMPIYMEFSDDAEDTYARSLKLLQDENMLKEGQHVTLVQSGAQPIWREESTHLIQVRKIKIG

SEQ ID NO: 780 - DNA, 2091 bp, Zea mays
  CDS (1)..(1680)
atgtactgtgtttggcaattggattccaagcgctgtaattcgcagttgatgctcgtaatatcagttgttgctgcgggctcgttactgaacagaggacagttaatcacttcagtggttactaaatgtggtgacaaggtgctttatgtggtgacgattttaccatttctgatgcagatgtatagtgaggctagtagtgaaatcccttcacaggcagctattgcaaattctaggaggaagacaaagatagtatgcaccataggtccctcaaccaacactcgtgagatgatttggaagcttgcagagactggaatgaatgtagcacgccttaatatgtcccatggtgaccaccagtcacaccagaaggttatcaatttggtcaaggagtacaatgcacagaacactgatggaaatgttattgccatcatgctggacactaagggtcctgaagttagaagtggggatgttccagagccaattatgctcagtgaagggcaagagttcaatttcacaattaaaagaggggtgagcactgaagacactgtcagcgtgaactatgatgacttcataaatgatgttgaagctggtgacatactgttagtggatggaggaatgatgtcgcttgctgtgaagtctaaaacagctgatacagtcaagtgtgaagtagttgacggcggggaattgaaatcaaggcgccacctaaatgttcgtggaaaaagtgctactttgccatctatcactgagaaggattgggaagacataaaatttggtgtcgaaaacggtgttgatttctatgcagtttcctttgtgaaggatgccaaagttatccatgaattaaaggactacctaaaaggtgttaatgcggatatacatgtcattccaaaaattgaaagtgcagactcaataccaaatctgcagtccattattgctgcttcagatggggcaatggtggcacgtggagaccttggtgctgaacttccgattgaggatgttcctttgctacaggcagagattgttcaaacatgtcgaaacatggagaaaccagttattgtcgccacaaatatgttggaaagcatgattgaccatcctactccaactagggcagaagtttctgacatagctattgcagtcagggaaggtgctgatgccatcatgttatctggtgaaactgctcatggaaagtacccactaaaggcagtcaaggtgatgcacactgtggccctcagaacagaatccagcatttataacccaactacttcccctagtgttatagcatctgcacagggtctacagaacgaggagttttccccaagccagctaagtaaaatgtttggatcccatgcaactatgatggccaacacccttcggacaccaatcattgtatttacgcagacaggctccatggctgtcctcctgagccactatcgtccctcgtctacaatatttgcgtttacaaacgaggaacgagtgaagctacggctagcactctaccagggggtcatccctattcacatggagttctctgacgacgcagaagaaactttctccagagcaattagcagcttgctgaaagcacaatatgtgaagaagggagactacgtcactcttgttcagagcggagtgacttcaatctggagagaggaatccactcacaacatccaagtgaggagagctcaggtctgatgtgctggtaggaatcagtcgccggagaagttttgatagcgccgctagaagtgttatcatcatcatcaccatcatatgcgagtaattttaatgttttaccaggagattgctacgtcgagttgtatgttgtgtcgaattcacgtgtagactctggatctttaactctgtattcgttcattttcacttgtttcacactggagtgctataagttcacgcttactgcctttgcttttgcttttgctttcttgtgaaacttgattttagtttcttgttacaaaaggagctagcactaacagcgtgttaaattttgtaaaacggggccttcttgctccgagaactgctcagttaaaactgttgcaacaataataaaaacgtccatgcaaggcgacaacatgcctggccagaaggccg

SEQ ID NO: 781 - protein, 559 aa, Zea mays
MYCVWQLDSKRCNSQLMLVISVVAAGSLLNRGQLITSVVTKCGDKVLYVVTILPFLMQMYSEASSEIPSQAAIANSRRKTKIVCTIGPSTNTREMIWKLAETGMNVARLNMSHGDHQSHQKVINLVKEYNAQNTDGNVIAIMLDTKGPEVRSGDVPEPIMLSEGQEFNFTIKRGVSTEDTVSVNYDDFINDVEAGDILLVDGGMMSLAVKSKTADTVKCEVVDGGELKSRRHLNVRGKSATLPSITEKDWEDIKFGVENGVDFYAVSFVKDAKVIHELKDYLKGVNADIHVIPKIESADSIPNLQSIIAASDGAMVARGDLGAELPIEDVPLLQAEIVQTCRNMEKPVIVATNMLESMIDHPTPTRAEVSDIAIAVREGADAIMLSGETAHGKYPLKAVKVMHTVALRTESSIYNPTTSPSVIASAQGLQNEEFSPSQLSKMFGSHATMMANTLRTPIIVFTQTGSMAVLLSHYRPSSTIFAFTNEERVKLRLALYQGVIPIHMEFSDDAEETFSRAISSLLKAQYVKKGDYVTLVQSGVTSIWREESTHNIQVRRAQV

SEQ ID NO: 782 - DNA, 1710 bp, Zea mays
  CDS (1)..(1710)
atggcggcagcggcggagatcggtggtttcgcggcggcgagagtggcggtggcgacgctcaggccggctgcgcacccagccccggcggcggcggcggcaccgcagcctaggagggcggtggcggcgcagtcgctgcggacgaccgccaccgaggcgctgacggcggatctcgccggcacgaccaacggcgctgtgcatgctcggatgaatagtaaggctacaagtgaaatcacttcacaggcagttactgcaaattctaggagaaagacaaagatagtctgcaccataggtccctcaaccaacactcgtgagatgatttggaagcttgcagagactggaatgaatgtagcacgccttaatatgtcccatggtgaccaccagtcgcaccagaaggttattgatttggtcaaggagtacaatgcacagaacactgatggcaatgttattgccattatgctggacacaaagggtcctgaagttagaagtggggatgttccagagccaatcatgctcaaggaaggtcaagagttcaacttcacgattaaaagaggggtgagcactgaagacactgtcagcgtgaactatgatgacttcataaatgatgttgaagctggcgacatactattagtggatggaggaatgatgtcgcttgctgtgaagtctaaaacagccgatacagtcaagtgtaaagtagttgatggtggggaattgaaatcacggcgccacctaaatgtccgtggaaagagtgctactttgccatctatcactgagaaggattgggaagacataaaatttggtgtcgaaaacggtgttgatttctatgcagtttcctttgtgaaggatgccaaagttatccatgaattaaaagactaccttaaaagtgctaatgccgatatacatgtcattccaaaaattgaaagtgcagattcaataccaaacctgcagtccattattgctgcttcagatggggcaatggtggcgcgtggagaccttggtgctgaacttccgattgaggatgttcctttgctacaggcagagattgtccaaacatgtcgaagcatggagaaaccagtcattgtcgctacaaatatgttggaaagcatgattgaccatcctactcccactagggcagaagtttctgacatagctattgcagttcgggaaggtgctgatgccatcatgttatctggcgaaactgctcatggaaagtatccactaaaggcagtcaaggtgatgcacactgtggcactcagaacagaatccagcctttataacccaactacttctcctagtcttgttgcatctgcacagggtctacagaatgaggacttctccccaagccagctaagtaaaatgttcggatctcatgcaacgatgatggccaacacccttcgcacaccaatcattgtatttacacagacaggctccatggctgtcctcctgagccactatcgtccctcgtctacactatttgcatttacaaacgaggaacgagtgaagcaacggctagcactctaccagggcgtcatccctattcacatgcagttctctgacgacgcagaagaaactttctccagagcaattagcagcttgctgaaagcacaatatgtgaagaagggagactacgtcactcttgttcagagcggagtgacttcaatctggagagaggaatccactcaccacatccaagtgaggaaagttcaggtctga

SEQ ID NO: 783 - protein, 569 aa, Zea mays
MAAAAEIGGFAAARVAVATLRPAAHPAPAAAAAPQPRRAVAAQSLRTTATEALTADLAGTTNGAVHARMNSKATSEITSQAVTANSRRKTKIVCTIGPSTNTREMIWKLAETGMNVARLNMSHGDHQSHQKVIDLVKEYNAQNTDGNVIAIMLDTKGPEVRSGDVPEPIMLKEGQEFNFTIKRGVSTEDTVSVNYDDFINDVEAGDILLVDGGMMSLAVKSKTADTVKCKVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEDVPLLQAEIVQTCRSMEKPVIVATNMLESMIDHPTPTRAEVSDIAIAVREGADAIMLSGETAHGKYPLKAVKVMHTVALRTESSLYNPTTSPSLVASAQGLQNEDFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 784 - DNA, 2281 bp, Zea mays
  CDS (187)..(1914)
gccggccggggcaaaacccgagcctcgcgacctgcttacgagacaagtaatttacgtgcgtcgagttccatctggccttaaacccaccccggcatcgggcacgccgcacgccacgcctcaccgagtcaccgtcccagtcagctacccttccccctaccaattccaaatctctcacccggcttgaggatggcggcgcaggtggtggcagcggcgggcaccccggtggccaggccgctgggcggcggatctggggccgacgcgctccggccagcggcaacgatgccaagggagagaaggaccggtgctgtggccgcgagaggacgccgcgagtctcaggtggtatccgtcataagccgcgccccacgccccgatgccggggtgctgccggtgtcgcccgacgacgacgcggccgtaaaggaagaagcaaacttccagcaccttaaggctatccagcaacttgcaactgcagcaaatggcgtgtggtctaaaccaaatgtaaggcgcaagacaaagattgtgtgtacaatcggtccttcaaccaacacaagggacatgatatggaaactcgctgagactggcatgaatgtggctcggcttaatatgtcacatggagaccatgcatcacaccagaaagttattgatctggtaaaggagtacaatgcatcacatgctgacaatgtgattgctatcatgcttgacacaaagggaccagaagttcgaagtggagatttgcctcaaccgatatttctggaaagcggacaagaatttacttttacaatcaaaaggggagttgggactgatacgtgtgttagcgttaactatgacgactttgttaatgatgttgaagtgggcgacatgctccttgtagatggaggaatgatgtcattcttggtcaaatcaaaaactgaagattctgtgaaatgtgaagttattgacggtggtgaattgaaatctaggcgccatctgaatgttcgtggaaagagtgcaaccttgccatcaataactgacaaggactgggacgacattaagtttggtgtggataatcaagttgattactatgctgtttcttttgtgaaagatgctcaagttgtccacgaactcaaggattatctaaaaagttgcaatgctgacatacatgttatcgtaaaaatagaaagtgcagactccatccccaacttacattcaatcatcacagcatctgatggggctatggttgccaggggtgaccttggagctgagctgcccattgaggaggtgccgctgttgcaggaagaaattattagaatgtgcaggagcatggggaaggctgttattgttgctacaaatatgctcgaaagtatgattgttcatccaactccaacccgagcagaagtttcagacattgctatagctgtccgagagggtgctgatgcagttatgctttcaggagaaactgcacatgggaaatttcccttgaaagctgttaaggtcatgcacactgttgccctgagaaccgaggcaactattcctggtggggaaacacctgcagaccttggtcaggctttcaagaaccacatgagcgaaatgttcgcataccatgcgacaatgatgtcaaatacccttcgaacatcaatagtggttttcactaggacgggatttatggctatactgcttagtcactaccgtccatctggcactatttttgccttcacagacgaggagagagttaggcaacgattggctttgtaccaaggtgtatgtccggttcaaatggaattttctgatgatgctgagaagacatttggcaatgctttgtcttatttgctgaaacatggtatggttaaggacggtgaggaggttgcacttgttcaaagtggtaaacatcccatctggagatcacaatcaacacacaacattcaggtgaggaagatctgatgcggaacgcacatagtattctgattgttggaggacatcgtttcttctagcaaaccgcaaggtcttgttacaatgaaactacactggtagtaagtactggtattggtgagatagttggtgctgagctagtgttgtgattctttttcttacttgtgcactagtgctgttttccttccgtgtaaaaaggccaatccaattgccgcttggttttagctgtagctttggaaactgtaggcttgttgttgtaatacagttcgttctttgtcaatgttaaggacttttgcctcgagagctaggcataactcgaagctcaccaaacagcaatctacctgcaaattgcaacgcattttgcgtatttaaagcggcc

SEQ ID NO: 785 - protein, 575 aa, Zea mays
MAAQVVAAAGTPVARPLGGGSGADALRPAATMPRERRTGAVAARGRRESQVVSVISRAPRPDAGVLPVSPDDDAAVKEEANFQHLKAIQQLATAANGVWSKPNVRRKTKIVCTIGPSTNTRDMIWKLAETGMNVARLNMSHGDHASHQKVIDLVKEYNASHADNVIAIMLDTKGPEVRSGDLPQPIFLESGQEFTFTIKRGVGTDTCVSVNYDDFVNDVEVGDMLLVDGGMMSFLVKSKTEDSVKCEVIDGGELKSRRHLNVRGKSATLPSITDKDWDDIKFGVDNQVDYYAVSFVKDAQVVHELKDYLKSCNADIHVIVKIESADSIPNLHSIITASDGAMVARGDLGAELPIEEVPLLQEEIIRMCRSMGKAVIVATNMLESMIVHPTPTRAEVSDIAIAVREGADAVMLSGETAHGKFPLKAVKVMHTVALRTEATIPGGETPADLGQAFKNHMSEMFAYHATMMSNTLRTSIVVFTRTGFMAILLSHYRPSGTIFAFTDEERVRQRLALYQGVCPVQMEFSDDAEKTFGNALSYLLKHGMVKDGEEVALVQSGKHPIWRSQSTHNIQVRKI

SEQ ID NO: 786 - DNA, 1740 bp, Arabidopsis thaliana
  CDS (40)..(1740)
atggctcaagtggttgctaccaggtcaattcaaggctcgatgttatctcccaacggtggatctgtgtctacaagatccgagaagctattgaaaccagcgagttttgcagtgaaggttcttggcaacgaagcaaagagaagtggaagagtctctgtaagaagcagaagagtggttgatactactgtgagatccgctcgtgttgagactgaagtcattcctgtttctcctgaagatgtgcctaacagagaggagcagcttgagaggttgttggaaatgcagcagtttggtgatacatcggtagggatgtggtcgaagccgacagtgaggaggaagacaaagattgtttgcaccgttggtccgtcgaccaacacacgagaaatgatatggaaattggctgaagctgggatgaatgttgctaggatgaatatgtctcatggagatcatgcttcacataagaaggttattgatttggttaaagaatacaatgcacaaactaaagacaacactattgctatcatgcttgacaccaagggtccggaagttaggagtggagatttacctcagccaattatgttagatcctggtcaagagtttacctttacaattgagagaggagtcagcacaccaagttgtgtcagtgttaactatgatgatttcgttaatgacgtggaagcgggtgacatgcttcttgttgatggtggtatgatgtcgtttatggtgaagtcaaagaccaaagactctgtcaaatgtgaagttgttgatggtggagaacttaagtcaaggagacacctgaatgtccgaggaaagagtgcaactttaccttcaatcactgagaaggactgggaggatattaaatttggagtggagaacaaagttgacttttatgcagtttcctttgtcaaagatgctcaagttgtacacgagttgaagaaataccttcaaaatagtggtgctgatatacacgtgatagtgaaaattgagagtgcagactccatacctaacttgcactccattatcacagcaccagatggggcaatggttgcaagaggtgatcttggtgcagagcttccaattgaagaagtccccattcttcaggaggagatcattaacctgtgccgtagtatgggaaaagctgttattgttgcgactaacatgcttgagagtatgatagttcatccaactccaacccgggcagaggtctcagacattgctatcgctgttagagaaggtgctgatgcggtaatgctttcaggagaaactgctcacggaaagttcccattgaaagctgctggagtgatgcacactgttgcattgcgaacagaagcaaccattactagcggtgaaatgccacctaatcttggtcaagccttcaagaaccatatgagtgagatgtttgcataccatgcaaccatgatgtcaaacacacttggaacttcaactgttgtcttcaccagaaccggtttcatggccatattgttaagtcactatcgtccttccggcacaatctatgccttcacaaatgagaaaaaaatacaacaaagattagctttgtatcaaggtgtatgccccatatatatggagttcacagatgatgcagaagaaacttttgctaatgctttggctacattactgaaacaaggaatggtgaagaagggagaggaaatagcaatcgtacagagcggtacacagccaatctggcgatctcaatcgacacataacatccaagtccgcaaggtttaa

SEQ ID NO: 787 - protein, 566 aa, Arabidopsis thaliana
MLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITAPDGAMVARGDLGAELPIEEVPILQEEIINLCRSMGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 788 - DNA, 1983 bp, Brassica napus; identical to SEQ ID NO: 778
  CDS (100)..(1815)

SEQ ID NO: 789 - protein, 571 aa, Brassica napus; identical to SEQ ID NO: 779

SEQ ID NO: 790 - DNA, 1965 bp, Glycine max
  CDS (127)..(1764)
ctgaccaccagaagaatgggacctggttggttgaaagtggagcgaagaaaactaacggagacttgtttggaagctagtctctggtgagagtgaaggcgcaccatcttcaccttgaagtcaacgatcatggcaaccattaacctttcttccgctactacgtctctcttccaatccaaacaccgaacgaaacgcattccacgcctccctacaatcgccagaataacaaaccacatcgaaggaactcatcttaactcccccaacggctctcccatccttggcaacgcaaacaattcccttgaggttccctccaataactatatctcgctacactcttcagacgtgcgtaggaaaactaagatcgtgtgcacgataggtccttctacgagctcacgtgatatgatatggaacctggctcaagctggaatgaacgtggcgcgtttgaacatgtcgcatggggaccacgcctcgcacctccaaaccattgatttggtgaaagaatacaattctcagtttcaagataaggttgtagccatcatgctcgacaccaagggtcctgaagttagaagtggggatgtagctcaacctattttacttaaagagggacaagaattctgtttcaccactatgagaggggttagcacacatgacacggttagcgtgaactacgatggctttgtgaatgatgtggagttcggagatgtgttgctggttgatggaggaatgatgtctcttgctgttaagtcaaagacaaaagacttggttaaatgtgaagttattgatggtggtgaactgaaatctaggcgtcatttaaatgtccgtggaaaaagtgcaacacttccttccataactgacaaggactgggaagatatcaagtttggggtggacaatcaagtagacttctttgctgtctcatttgtcaaggatgctagagtggtgcacgagttaaaacactacctcaaaagtcataatgccgatatacacgtgattgtaaaaattgaaagtgcagattccataccaaatctccattcgatactttctgcttcagatggggccatggtcgctcgtggggatcttggagctgaacttccaatagaggaagttcctttattgcaggaagacatcattcgaagatgtcaaattatgcaaaagcctgttattgtggcaacaaatatgcttgaaagcatgattaatcatcccacaccaacaagggcagaagtttcagacatcgcaattgcagtaagacaaggtgctgatgctatcatgctttcaggagaaactgcacatggaaaatttccattgaaagctgttaaagttatgcacacggtggctcttaggaatgaatccagtgttcaaagtggtgtttcttatccgagtcaactgagttcccatgaaagtcatatgggagaaatgtttgctttccatgcgacaacaatgtctaacactcttaatactcctattattgttttcaccagaacaggatccatggcaattcttttgagccattataggccttactcaacaatctttgcattcacaaatgaagcaagaattaagcagaggttggcgctttatcatggggttatgtccatatacatgcaattttcaaatgatgtagaagagaccttctctagagccctcaagctactattgagtaagagtcatttacacgagggacaacatgtcacacttgttcaaagtggagcacaaccaatctggcgtgaggaatccactcaccacatacaagttcgcaaggttcatggataaaattctatgaaggatctttgttcctcataagtgtacagtttttttccccactatcttgtaactattcatagtaatggctattcactatcttgtaactattcatagttatgactattatgcacttgaaacaccaaagttggatagtaaaggaattttcataatgcaaatagtgatttattgataaggaaaaaaaaaaaaaaa

SEQ ID NO: 791 - protein, 545 aa, Glycine max
MATINLSSATTSLFQSKHRTKRIPRLPTIARITNHIEGTHLNSPNGSPILGNANNSLEVPSNNYISLHSSDVRRKTKIVCTIGPSTSSRDMIWNLAQAGMNVARLNMSHGDHASHLQTIDLVKEYNSQFQDKVVAIMLDTKGPEVRSGDVAQPILLKEGQEFCFTTMRGVSTHDTVSVNYDGFVNDVEFGDVLLVDGGMMSLAVKSKTKDLVKCEVIDGGELKSRRHLNVRGKSATLPSITDKDWEDIKFGVDNQVDFFAVSFVKDARVVHELKHYLKSHNADIHVIVKIESADSIPNLHSILSASDGAMVARGDLGAELPIEEVPLLQEDIIRRCQIMQKPVIVATNMLESMINHPTPTRAEVSDIAIAVRQGADAIMLSGETAHGKFPLKAVKVMHTVALRNESSVQSGVSYPSQLSSHESHMGEMFAFHATTMSNTLNTPIIVFTRTGSMAILLSHYRPYSTIFAFTNEARIKQRLALYHGVMSIYMQFSNDVEETFSRALKLLLSKSHLHEGQHVTLVQSGAQPIWREESTHHIQVRKVHG

SEQ ID NO: 792 - DNA, 2245 bp, Zea mays
  CDS (138)..(1847)
cgaaaaccctcgcggcgaggagcgctctccgtcccacacacgcgcgccgcagcctccgcagtccgcacctgcctccacgacctgtcgtgctcgtgcgctactctcctcgagcgcggcgcggagcacggggacatcaaatggcggcagcggcggagatcggtggtttcgcggcggcgagagtggcggtggcaacgctcaggccggctgcgcacccagccccggcggcggcggcggcaccgcagcctaggagggcggtggcggcgcagtcgctgcagacgaccgccaccgaggcgctgacggcggatctcgccggcacgaccaacggcgctgtgcatgctcggatgaatagtaaggctacaagtgaaatcacttcacaggcagttactgcaaattctaggagaaagacaaagatagtctgcaccataggtccctcaaccaacactcgtgagatgatttggaagcttgcagagactggaatgaatgtagcgcgccttaatatgtcccatggtgaccaccagtcgcaccagaaggttattgatttggtcaaggagtacaatgcacagaacactgatggcaatgttattgccattatgctggacacaaagggtcctgaagttagaagtggggatgttccagagccaatcatgctcaaggaaggtcaagagttcaacttcacgattaaaagaggggtgagcactgaagacactgtcagcgtgaactatgatgacttcataaatgatgttgaagctggcgacatactattagtggatggaggaatgatgtcgcttgctgtgaagtctaaaacagccgatacagtcaagtgtaaagtagttgatggtggggaattgaaatcacggcgccacctaaatgtccgtggaaagagtgctactttgccatctatcactgagaaggattgggaagacataaaatttggtgtcgaaaacggtgttgatttctatgcagtttcctttgtgaaggatgccaaagttatccatgaattaaaagactaccttaaaagtgctaatgccgatatacatgtcattccaaaaattgaaagtgcagattcaataccaaacctgcagtccattattgctgcttcagatggggcaatggtggcgcgtggagaccttggtgctgaacttccgattgaggatgttcctttgctacaggcagagattgtccaaacatgtcgaagcatggagaaaccagtcattgtcgctacaaatatgttggaaagcatgattgaccatcctactcccactagggcagaagtttctgacatagctattgcagttcgggaaggtgctgatgccatcatgttatctggcgaaactgctcatggaaagtatccactaaaggcagtcaaggtgatgcacactgtggcactcagaacagaatccagcctttataacccaactacttctcctagtcttgttgcatctgcacagggtctacagaatgaggacttctccgcaagccagctaagtaaaatgttcggatctcatgcaacgatgatggccaacacccttcgcacaccaatcattgtatttacacagacaggctccatggctgtcctcctgagccactatcgtccctcgtctacactatttgcatttacaaacgaggaacgagtgaagcaacggctagcactctaccagggcgtcatccctattcacatgcagttctctgacgacgcagaagaaactttctccagagcaattagcagcttgctgaaagcacaatatgtgaagaagggagactacgtcactcttgttcagagcggagtgacttcaatctggagagaggaatccactcaccacatccaagtgaggaaagttcaggtctgatgtgccggtgggaattggtcgtctgagaaattttgatagcgccgcctgatgtgttatcatcattatatgtgtaattttactgttttaccaggagattgctacgtcgagttatatgttgtgtcgaattcacgtgtaggctctgaatcttgactgtgttcgttcattttcgcttgtttcacactgaagtgttataagctcaactttactgcttttgttttcttgtgaaacttgagtttagtttcttgttacaaaaggagctagcactaacagggtggtgagttttgtaaacggggcgaggactgttgagttaaaactgttgtaataatgatatcgttcctgcaagacgacacatgcatggccagaaggccaaagtcaaaaaaaaaaaaaaaaaaaaaaaa

SEQ ID NO: 793 - protein, 569 aa, Zea mays
MAAAAEIGGFAAARVAVATLRPAAHPAPAAAAAPQPRRAVAAQSLQTTATEALTADLAGTTNGAVHARMNSKATSEITSQAVTANSRRKTKIVCTIGPSTNTREMIWKLAETGMNVARLNMSHGDHQSHQKVIDLVKEYNAQNTDGNVIAIMLDTKGPEVRSGDVPEPIMLKEGQEFNFTIKRGVSTEDTVSVNYDDFINDVEAGDILLVDGGMMSLAVKSKTADTVKCKVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEDVPLLQAEIVQTCRSMEKPVIVATNMLESMIDHPTPTRAEVSDIAIAVREGADAIMLSGETAHGKYPLKAVKVMHTVALRTESSLYNPTTSPSLVASAQGLQNEDFSASQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 794 - DNA, 1740 bp, Arabidopsis thaliana
  CDS (1)..(1740)
atggctcaagtggttgctaccaggtcaattcaaggctcgatgttatctcccaacggtggatctgtgtctacaagatccgagaagctattgaaaccagcgagttttgcagtgaaggttcttggcaacgaagcaaagagaagtggaagagtctctgtaagaagcagaagagtggttgatactactgtgagatccgctcgtgttgagactgaagtcattcctgtttctcctgaagatgtgcctaacagagaggagcagcttgagaggttgttggaaatgcagcagtttggtgatacatcggtagggatgtggtcgaagccgacagtgaggaggaagacaaagattgtttgcaccgttggtccgtcgaccaacacacgagaaatgatatggaaattggctgaagctgggatgaatgttgctaggatgaatatgtctcatggagatcatgcttcacataagaaggttattgatttggttaaagaatacaatgcacaaactaaagacaacactattgctatcatgcttgacaccaagggtccggaagttaggagtggagatttacctcagccaattatgttagatcctggtcaagagtttacctttacaattgagagaggagtcagcacaccaagttgtgtcagtgttaactatgatgatttcgttaatgacgtggaagcgggtgacatgcttcttgttgatggtggtatgatgtcgtttatggtgaagtcaaagaccaaagactctgtcaaatgtgaagttgttgatggtggagaacttaagtcaaggagacacctgaatgtccgaggaaagagtgcaactttaccttcaatcactgagaaggactgggaggatattaaatttggagtggagaacaaagttgacttttatgcagtttcctttgtcaaagatgctcaagttgtacacgagttgaagaaataccttcaaaatagtggtgctgatatacacgtgatagtgaaaattgagagtgcagactccatacctaacttgcactccattatcacagcatcagatggggcaatggttgcaagaggtgatcttggtgcagagcttccaattgaagaagtccccattcttcaggaggagatcattaacctgtgccgtagtatgggaaaagctgttattgttgcgactaacatgcttgagagtatgatagttcatccaactccaacccgggcagaggtctcagacattgctatcgctgttagagaaggtgctgatgcggtaatgctttcaggagaaactgctcacggaaagttcccattgaaagctgctggagtgatgcacactgttgcattgcgaacagaagcaaccattactagcggtgaaatgccacctaatcttggtcaagccttcaagaaccatatgagtgagatgtttgcataccatgcaaccatgatgtcaaacacacttggaacttcaactgttgtcttcaccagaaccggtttcatggccatattgttaagtcactatcgtccttccggcacaatctatgccttcacaaatgagaaaaaaatacaacaaagattagctttgtatcaaggtgtatgccccatatatatggagttcacagatgatgcagaagaaacttttgctaatgctttggctacattactgaaacaaggaatggtgaagaagggagaggaaatagcaatcgtacagagcggtacacagccaatctggcgatctcaatcgacacataacatccaagtccgcaaggtttaa

SEQ ID NO: 795 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITASDGAMVARGDLGAELPIEEVPILQEEIINLCRSMGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 796 - DNA, 1716 bp, Arabidopsis thaliana
  CDS (1)..(1716)
atggctgcttatggtcaaatctcctcgggaatgactgtagatcctcaggttctctcttcctccagaaacattggagtttccctatcacctctccggagaacactaatcggcgccggagttaggtctactagtatctctctccgtcaatgttctctctccgttagatcgattaaaatctccgaagatagccgcaaacctaaagcttatgcagagaacggtgcttttgatgtgggagttttggattcttcatcatatagattggctgattcaagaacaagtagtaatgattcaaggaggaagactaagattgtgtgtacgattggaccgtcttcgagttctagggaaatgatttggaaactcgcggaagctggaatgaatgtggctcgtttgaatatgtctcatggtgatcatgcttctcatcagataactattgatttagttaaggagtataattctttgtttgttgacaaagctattgctattatgttggatacaaagggtcctgaggttcgaagcggggatgtaccgcagccgatatttcttgaagagggtcaagagtttaactttactatcaagagaggtgtttcgcttaaagacactgttagtgtaaattatgatgattttgtgaacgatgttgaagttggggatatacttttggtggatggtggaatgatgtcgttagctgttaaatcaaagacgagtgatttggtgaagtgtgtggttattgatggtggagagcttcaatctagacgtcacttgaatgttcgaggaaagagtgcgactcttccatccattacagacaaagattgggaagacataaaatttggagtggacaaccaagtcgatttctacgccgtctcctttgttaaggatgctaaagttgtccatgagttgaagaactatctcaaaacctgcagtgcagacatatcggtgattgtgaaaattgaaagtgcagactctataaagaatcttccttctatcatatctgcttgtgatggggcaatggttgctcgtggagatcttggagctgaacttcccattgaagaggtcccgttgttacaggaagaaataatcagaaggtgtagaagcattcataaaccagtgattgttgccacaaacatgctagagagtatgattaatcatccaacgcctacaagagctgaagtctctgacattgcaattgcagtacgtgaaggcgcagatgctatcatgctttctggtgaaaccgcacatggaaagtttccgctgaaagctgttaacgtaatgcatactgtggcgttgagaaccgaggcaagtctacctgtcagaacctcggcatcccgtaccactgcttacaagggtcacatgggccaaatgtttgcttttcatgcttctataatggcaaatacactgagctcaccgctaattgtatttacgagaaccggatccatggcagtgcttctaagccactaccgcccatctgcaacaattttcgccttcacaaaccagagaagaataatgcaaaggcttgctctttatcaaggtgtcatgcctatatatatggagttctcggatgatgcagaagatacatatgcccggtctctcaaactcttacaggacgagaatatgctcaaggaaggacaacatgtaactcttgtccaaagtggctcgcaacccatttggcgtgaagaatcaacacatctcatacaagtccgtaagataaagataggtggatga

SEQ ID NO: 797 - protein, 571 aa, Arabidopsis thaliana
MAAYGQISSGMTVDPQVLSSSRNIGVSLSPLRRTLIGAGVRSTSISLRQCSLSVRSIKISEDSRKPKAYAENGAFDVGVLDSSSYRLADSRTSSNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSLKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKTCSADISVIVKIESADSIKNLPSIISACDGAMVARGDLGAELPIEEVPLLQEEIIRRCRSIHKPVIVATNMLESMINHPTPTRAEVSDIAIAVREGADAIMLSGETAHGKFPLKAVNVMHTVALRTEASLPVRTSASRTTAYKGHMGQMFAFHASIMANTLSSPLIVFTRTGSMAVLLSHYRPSATIFAFTNQRRIMQRLALYQGVMPIYMEFSDDAEDTYARSLKLLQDENMLKEGQHVTLVQSGSQPIWREESTHLIQVRKIKIGG

SEQ ID NO: 798 - DNA, 1872 bp, Oryza sativa
  CDS (1)..(1872): Japonica cultivar group
atggcgcaggtggtggctgcggcagggacggcggcggcggtggcggcggtggggaggccgctgggtggcggcggatctggggccgacgcgctccgcccggcggcgaggctgtcgttcgcgccgcgctggtgcggtgggagcgcgggggcagcaagggcgcgccgcgagtccgccgtcacgtccgtgattagccgcgccccgcgtctcgacgccgaggtgctgccggtgtcggccgacgacgacgcggacgaagaagaaaacttccagcatctcaaggccattcagcaacttgcaacatcagccaatggtgtgtggtctaaaccaaatgtgagacgcaagacaaagatcgtgtgcaccattggtccttcaactaacacaaaggagatgatatggaaacttgctgaggctggcatgaatgtggctcggcttaatatgtcacatggagaccatgcatcacaccagaaagttattgacttagtaaaggaatataatgctcaaacaaaggataacgtgattgctattatgcttgacacgaagggaccagaagttaggagtggagatttgcctcaaccaataatgttggaaactggccaggagttcactttcacaattaagagaggagttgggactgagacatgtgttagcgttaactatgatgactttgttaatgatgtagaagtgggtgacatgctcctcgtagatggtggaatgatgtcgttgttggtcaagtccaaaactgaagattcggtaaaatgtgaagttattgatggaggtgaactgaaatccaggcgtcacctgaatgttcgtggaaagagcgcaaccttgccatcaataactgacaaggattgggatgatattaagtttggtgtggagaatcaagttgactactatgccgtttcttttgtcaaagatgctcaagttgtgcatgaattgaaggattatctcagaagctccaatgccgatatacatgtaattgtaaagattgaaagtgcagattccattccaaacctacactcaatcatcacagcatcggatggggctatggttgccagaggtgacttgggagctgaactccctattgaggaggtaccgctgctgcaggaagaaattattagaatgtgcaggagcatgggaaaagctgttattgttgccactaatatgctagaaagtatgattgttcatccaactccaacccgagcagaagtttcagacattgctatagctgttcgagaaggttctgatggcattatgctttctggggaaactgcacacggaaagtttcctttgaaagctgttaaggtcatgcatactgttgccctgagaactgaagccactatgtctggtggggaaacaccggctaaccttggtcaggtgttcaagaatcacatgagtgaaatgtttgcataccattcaacaatgatgtccaacactcttggaacatcaattgtggttttcaccaggacaggatttatggctatcctacttagtcattaccgcccttctggcaccatttttgcctttacggaccaggagagagttagacaacgattggctttgtaccaaggtgtatgtccagtccagatggaattttctgatgatgctgagaagacatttggtgacgctttgtcatacttgctgaaacatggtatggtgaaggaaggcgaggaggttgcacttgttcaaagtggcaggcaacctatctggcggtcgcagtccacccataatattcagcaaaaccttaggcctgatgataataccacgctggcattactggcatcatttaactgtgagcttagtgagttgtgtgcaagacatgagagagccattgttgtgattctatattcgttgctaaatatgttaccttgcatgtaa

SEQ ID NO: 799 - protein, 623 aa, Oryza sativa
  Japonica cultivar group
MAQVVAAAGTAAAVAAVGRPLGGGGSGADALRPAARLSFAPRWCGGSAGAARARRESAVTSVISRAPRLDAEVLPVSADDDADEEENFQHLKAIQQLATSANGVWSKPNVRRKTKIVCTIGPSTNTKEMIWKLAEAGMNVARLNMSHGDHASHQKVIDLVKEYNAQTKDNVIAIMLDTKGPEVRSGDLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMAILLSHYRPSGTIFAFTDQERVRQRLALYQGVCPVQMEFSDDAEKTFGDALSYLLKHGMVKEGEEVALVQSGRQPIWRSQSTHNIQQNLRPDDNTTLALLASFNCELSELCARHERAIVVILYSLLNMLPCM

SEQ ID NO: 800 - DNA, 1713 bp, Oryza sativa
  CDS (1)..(1713): Japonica cultivar group
atggcggcggcggcggctgagatcgtggggtccgcggcggcgcgcatggcggcgccggcagtgaggccggctccgcccgcggcggcggcggcggcggcgcccccgcagccgaggagggccgtggcggcgcgctccctcaggacctccacctccgacagggtggcggcggatctcgcgctcgggagcaacggctccctctccgctcagaacattgctgagaataccgctgacgctacttcgcaagtggtctctgcgaattcccgtaggaagacaaagattgtttgcaccataggcccctcaaccaacacacgcgagatgatatggaaacttgctgagactggaatgaacgtcgcacgcatgaatatgtcccatggtgaccaccagtcgcaccagaaggtgattgatttggtgaaggagtacaatgcgaagaatactgatggcaatgtcattgctattatgctggataccaagggtccagaagtgagaagtggggatgttccagaaccaatcatgctcgaggaaggtcaagagttcaattttactattaaaagaggggtgagcaccaaagacaccgtcagtgtgaattacgatgacttcataaacgatgttgaagttggggacatactgttggtggatggaggaatgatgtcactcgctgtcaagtctaaaacagctgatacggttaagtgtgaagtagttgatggtggggaactgaaatcaaggcgccacctaaatgtccgtggaaagagtgcgactttgccatctattacagagaaagattgggaggacataaagtttggtgttgaaaatggtgttgatttctatgccgtttcctttgtgaaggatgcaaaagttattcatgaactgaaggactaccttaaaagtgctaatgcagatatacatgtcattccaaagattgaaagtgcagattcaataccaaacctccagtccattattgctgcttcagatggggcgatggtggcaagaggggatcttggtgctgaacttccaattgaggaagttcctttgctgcaggaggagattgtcagaacatgccgaagcatgcagaaaccagttattgttgccacgaatatgttagagagcatgatagaccatcccactccaacaagagcagaagtttctgatatagcaattgcagttcgtgaaggttctgatgccatcatgctgtctggtgaaactgcccatggaaagttcccactgaaggcagtcaaggtgatgcacacagtggcacagagaacagaatccagcctgtataacccaactacatctcctagtcttgttgcacatcctcaggctctgctcaacgaggaattttcgcaaagccaactaagcaaaatgtttggatctcatgctacaatgatggcgaacaccctttgcaccccaattattgtgtttacacgaaccggctccatggcagtccttctcagccactaccggccctcgtctacaatttttgcatttacaaatgaggaacgagtgaagcaacgtctggcactctaccagggtgtggttcccatttacatgaagttttctgatgatgcagaggaaactttctctagagcaattagtagcttgctgaacgcccaattcgtgaaagaaggggactacgtgacccttgttcagagtggagtgaagtcgatctggagagaggagtctactcaccacattcaagtgaggaaagtccagggctaa

SEQ ID NO: 801 - protein, 570 aa, Oryza sativa
  Japonica cultivar group
MAAAAAEIVGSAAARMAAPAVRPAPPAAAAAAAPPQPRRAVAARSLRTSTSDRVAADLALGSNGSLSAQNIAENTADATSQVVSANSRRKTKIVCTIGPSTNTREMIWKLAETGMNVARMNMSHGDHQSHQKVIDLVKEYNAKNTDGNVIAIMLDTKGPEVRSGDVPEPIMLEEGQEFNFTIKRGVSTKDTVSVNYDDFINDVEVGDILLVDGGMMSLAVKSKTADTVKCEVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEEVPLLQEEIVRTCRSMQKPVIVATNMLESMIDHPTPTRAEVSDIAIAVREGSDAIMLSGETAHGKFPLKAVKVMHTVAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQVRKVQG

SEQ ID NO: 802 - DNA, 1740 bp, Arabidopsis thaliana
  CDS (1)..(1740)
atggctcaagtggttgctaccaggtcaattcaaggctcgatgttatctcccaacggtggatctgtgtctacaagatccgagaagctattgaaaccagcgagttttgcagtgaaggttcttggcaacgaagcaaagagaagtggaagagtctctgtaagaagcagaagagtggttgatactactgtgagatccgctcgtgttgagactgaagtcattcctgtttctcctgaagatgtgcctaacagagaggagcagcttgagaggttgttggaaatgcagcagtttggtgatacatcggtagggatgtggtcgaagccgacagtgaggaggaagacaaagattgtttgcaccgttggtccgtcgaccaacacacgagaaatgatatggaaattggctgaagctgggatgaatgttgctaggatgaatatgtctcatggagatcatgcttcacataagaaggttattgatttggttaaagaatacaatgcacaaactaaagacaacactattgctatcatgcttgacaccaagggtccggaagttaggagtggagatttacctcagccaattatgttagatcctggtcaagagtttacctttacaattgagagaggagtcagcacaccaagttgtgtcagtgttaactatgatgatttcgttaatgacgtggaagcgggtgacatgcttcttgttgatggtggtatgatgtcgtttatggtgaagtcaaagaccaaagactctgtcaaatgtgaagttgttgatggtggagaacttaagtcaaggagacacctgaatgtccgaggaaagagtgcaactttaccttcaatcactgagaaggactgggaggatattaaatttggagtggagaacaaagttgacttttatgcagtttcctttgtcaaagatgctcaagttgtacacgagttgaagaaataccttcaaaatagtggtgctgatatacacgtgatagtgaaaattgagagtgcagactccatacctaacttgcactccattatcacagcatcagatggggcaatggttgcaagaggtgatcttggtgcagagcttccaattgaagaagtccccattcttcaggaggagatcattaacctgtgccgtagtatgggaaaagctgttattgttgcggctaacatgcttgagagtatgatagttcatccaactccaacccgggcagaggtctcagacattgctatcgctgttagagaaggtgctgatgcggtaatgctttcaggagaaactgctcacggaaagttcccattgaaagctgctggagtgatgcacactgttgcattgcgaacagaagcaaccattactagcggtgaaatgccacctaatcttggtcaagccttcaagaaccatatgagtgagatgtttgcataccatgcaaccatgatgtcaaacacacttggaacttcaactgttgtcttcaccagaaccggtttcatggccatattgttaagtcactatcgtccttccggcacaatctatgccttcacaaatgagaaaaaaatacaacaaagattagctttgtatcaaggtgtatgccccatatatatggagttcacagatgatgcagaagaaacttttgctaatgctttggctacattactgaaacaaggaatggtgaagaagggagaggaaatagcaatcgtacagagcggtacacagccaatctggcgatctcaatcgacacataacatccaagtccgcaaggtttaa

SEQ ID NO: 803 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITASDGAMVARGDLGAELPIEEVPILQEEIINLCRSMGKAVIVAANMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 804 - DNA, 1740 bp, Arabidopsis thaliana; identical to SEQ ID NO: 786
  CDS (1)..(1740)

SEQ ID NO: 805 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITAPDGAMVARGDLGAELPIEEVPILQEEIINLCRSMGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 806 - DNA, 1689 bp, Nicotiana tabacum
  CDS (1)..(1689)
atggccacaatgaatctacctacaggactacatgtcgcggctaaaccggcgtcattggatcggctttcctcggccaagaacgtcggtgatttgttcttctccgattctcgtcacaggaaacgagtgaatacttcgaatcaaatcatggccgttcaatcacttgagcatattcatggcgttaataacaatgtttatgccaattatgttaatttcaatgtaccctcttccggttacagtctggggcaagaaagtgtgtatctgaattctccaagaaaaaccaagatagtttgcaccattggtccctccacaagctcacgggagatgatctggaaattggcagaggctggaatgaacgtggcccgtctgaatatgtcacatggggaccacgcatcgcatcagagaacgattgaccttgttaaagaatacaatgctcaatttgaggacaaggttattgcaataatgttggacactaagggacctgaggtaataagtggagatgtgcccaaaccaattctccttaaggagggtcaagaattcaactttagcattaaaagaggagtcagcacagaagacaccgttagtgtaaattatgatgatttcataaatgatgtggaggccggagacatactactcgttgatggtgggatgatgtcattagctgtgaaatcgaaaaccagcgatatagtgaaatgtgaagttattgatggaggagaactgaaatcgagacggcatctaaatgtaagaggaaaaagtgccaccctgccttcaataacagaaaaagactgggatgatattaagtttggtgtgaacaatcaagtcgacttctatgccgtttcttttgtgaaggatgctaaggtggtccatgaattgaaagattacctgaaaagctgtaatgcagatattcatgttattgtaaagattgaaagtgcagactccattccaaatctccactcgatcatttccgcttccgatggggcaatggtggcccgtggtgatcttggagctgaacttccaattgaggaagtgccgttgcttcaggaagacattattagaaggtgtcagagcatgcaaaaacctgtaatagtagcaacgaacatgctcgaaagcatgattgatcacccaaccccaacaagggcagaagtttcagacatttccattgcagtacgtgaaggcgctgatgctgtaatgctttcaggcgaaaccgctcatgggaagtatccactgaaggcagttaaggtgatgcatattgtggcattaaggaccgagtctagcctacaaaaaagcactagttctcctagtcaatctgccgcctataagagccatatgggtgaaatgtttgccttccactcttcctcaatggctaatacccttagcactcccatcattgtcttcacaagaactgggtccatggcaataattttaagtcataatcggccttcatcaacagtttttgccttcacaaacaatgaaagggtgaagcagcgtctggctctgtatcatggtgtcgtgcctatatatatggagttttcaagtgacgcagaggagaccttttctcgagctatcaagcttttgttgagcaaaagcttggtgaaggatgggcaatatgtaactctcgtccaaagtggagcccaaccaatctggcgtagacattctactcaccacatacaagtccgtaaggtccaaagttga

SEQ ID NO: 807 - protein, 562 aa, Nicotiana tabacum
MATMNLPTGLHVAAKPASLDRLSSAKNVGDLFFSDSRHRKRVNTSNQIMAVQSLEHIHGVNNNVYANYVNFNVPSSGYSLGQESVYLNSPRKTKIVCTIGPSTSSREMIWKLAEAGMNVARLNMSHGDHASHQRTIDLVKEYNAQFEDKVIAIMLDTKGPEVISGDVPKPILLKEGQEFNFSIKRGVSTEDTVSVNYDDFINDVEAGDILLVDGGMMSLAVKSKTSDIVKCEVIDGGELKSRRHLNVRGKSATLPSITEKDWDDIKFGVNNQVDFYAVSFVKDAKVVHELKDYLKSCNADIHVIVKIESADSIPNLHSIISASDGAMVARGDLGAELPIEEVPLLQEDIIRRCQSMQKPVIVATNMLESMIDHPTPTRAEVSDISIAVREGADAVMLSGETAHGKYPLKAVKVMHIVALRTESSLQKSTSSPSQSAAYKSHMGEMFAFHSSSMANTLSTPIIVFTRTGSMAIILSHNRPSSTVFAFTNNERVKQRLALYHGVVPIYMEFSSDAEETFSRAIKLLLSKSLVKDGQYVTLVQSGAQPIWRRHSTHHIQVRKVQS

SEQ ID NO: 808 - DNA, 2046 bp, Brassica napus
  CDS (47)..(1789)
gctcccactctcattctttcgcaacttcttctccgcggaaaccaaaatggctcaggtcgttgctacaaggtcgattcaaggctcgatgttgagtcccaacggtggatctgtttccacgagatccgacaagcttctgaagccggcgagtttcgcagtgaaggttcttggcaacgaatccaagaagagcggaagagtgtccgtaagaggaggaagaaaggttgataccactgtgagatccgctcgtgtggagaccgaagtcattccagtgtctcccgaggatgttccaaacagagaggagcaactggagcggtttttggaaatgcagaagtttagtgacacatcggtagggatgtggtcgaaaccgacagtgaggaggaagactaagattgtgtgcaccgttggtccttctaccaacacacgagagatgatatggaaactagctgaagctgggatgaatgttgcaaggatgaacatgtctcatggggatcatgcttctcataagaaggttattgatttggtcaaagagtacaatgcgcagtctaaggacaacaccattgctatcatgctggatactaagggtccagaagttaggagtggagatttaccccagccgattatgttagaccctggtcaagagtttacttttacaattgagagaggagtcagcacaccaagctgtgtcagtgttaactatgatgattttgtcaacgatgtggaggccggagacatgctccttgttgatggtggtatgatgtcgtttatggtgaagtctaagactaaagagactgtcatatgtgaggttgttgatggtggagagctaaagtcaaggagacacttgaatgtccgaaggaaaagtgcaacattaccttcaatcactgagaaggattgggaggatattaagttcggagtggagaacaaagttgacttctatgctgtttcttttgtcaaagatgcacaagtggtgcatgaactgaagaattacctccaaggttgtggtgctgatattcacgtgatagtaaaaattgaaagcgcagactccatacctaacttgcattccattatcaccgcatcagatggggcaatggttgcaagaggtgatcttggtgcagagcttcctattgaagaagtacccattcttcaggaaaagatcattaacctatgccgtagcatgggaaaagctgttattgttgcaactaacatgcttgagagtatgatagttcatccgactccaacccgagcggaggtttctgatattgctatagctgttagagaaggtgctgatgcagtcatgctttcaggagaaactgctcacggaaagttcccattgaaagctgctggagtgatgcatacagttgcactgcgaacagaagcaaccattactactagtactgaaatgccacctaatcttggtcaagccttcaagaaccatatgagtgagatgtttgcataccatgcaaccatgatgtcaaacacacttggaacttcaactgttgtcttcacaagaactggtttcatggccatactactaagtcactatcgcccttccggcacaatctacgccttcacgaacgagaaaaaaatacagcaaagattagccttgtatcaaggtgtatgccccatatatatggagttctcagatgatgcagaagacactttcactaaagctttggctacactactgaaacaaggaatggtgaagaagggagaggaaatagcgattgtacagagcgggtcacaaccaatctggcggtctcaatcgactcataacatccaagtccgcaaggtgtaaggagactcagtatctcacctggtcaatgtttttctttcatttatctgtaaaaccggtttcggttatgtttccttgcacgtccttgtgtactctagaacctacagtttactgttatcttattcagtttgttttacttggcagacgttgttgttagctcattagttgtttgtgagacaaatgttaatttagattgagtaataaatgtgtgagaatcctctaatacacagctatgttgttgtaaaaaaaaaaaaaaaaaa

SEQ ID NO: 809 - protein, 580 aa, Brassica napus
MAQVVATRSIQGSMLSPNGGSVSTRSDKLLKPASFAVKVLGNESKKSGRVSVRGGRKVDTTVRSARVETEVIPVSPEDVPNREEQLERFLEMQKFSDTSVGMWSKPTVRRKTKIVCTVGPSTNTREMIWKLAEAGMNVARMNMSHGDHASHKKVIDLVKEYNAQSKDNTIAIMLDTKGPEVRSGDLPQPIMLDPGQEFTFTIERGVSTPSCVSVNYDDFVNDVEAGDMLLVDGGMMSFMVKSKTKETVICEVVDGGELKSRRHLNVRRKSATLPSITEKDWEDIKFGVENKVDFYAVSFVKDAQVVHELKNYLQGCGADIHVIVKIESADSIPNLHSIITASDGAMVARGDLGAELPIEEVPILQEKIINLCRSMGKAVIVATNMLESMIVHPTPTRAEVSDIAIAVREGADAVMLSGETAHGKFPLKAAGVMHTVALRTEATITTSTEMPPNLGQAFKNHMSEMFAYHATMMSNTLGTSTVVFTRTGFMAILLSHYRPSGTIYAFTNEKKIQQRLALYQGVCPIYMEFSDDAEDTFTKALATLLKQGMVKKGEEIAIVQSGSQPIWRSQSTHNIQVRKV

SEQ ID NO: 810 - DNA, 2245 bp, Glycine max
  CDS (232)..(1959)
gggaacatagcagatagtggtcagttcgatacaaacgaagaggagtctgtcgtgtcttgtgtcccagctctttatatttttctcatagcctgacctttgccgaacataacggcgatttctccaaaaccttcaattccaccttcttcttctcatcttcacaccctacccctttattcttcttcacacacaattccttcaactctctttctctctctctctctctctctaaaaatgtctcatgtagtggtcactcgatccattcacacctccctcacgcgccccacctcaggatctgcacaccacagagcccaaacgttgttgaagcctccaacttttgcttccaaagtgttcccacaacaaaggaacaacccctccaaagtttgctcccgaagttgcctcgtcaatgcgaggaaatctgcacccactgaagttgttcccgtctcacccgaggatgattcaaagattgaggaagagttgcagcactcgcgtggtatgcggcaacttggtgacacttctgttggaatgtggtcaaaacccacttttaggaggaagacaaaggttgtttgcaccattggtccttctaccaacaccagggaaatgatttggaagctggctgaggctgggatgaatgttgcccgattgaatatgtctcatggagaccatgcttctcatcagaaaattattgatttggttaaagaatataatgctcaatccaaggacaatgtaattgcaattatgcttgataccaagggtcctgaggttaggagtggggatttgccacaaccaatcaatttaacaactgggcaggaattcacatttaccatccggaggggtgttggaactgcagattgtgttagtgtgaactatgacgatttcgtcaatgatgtggatgtgggagacatgcttcttgttgatggtggtatgatgtctttggtggttaagtctaagacagaggattctgtgaaatgtgaagttgttgatggaggagagctcaagtcaaggagacatttgaacgttagaggaaaaagtgcaacactgccttcaatcactgagaaggattgggatgacatcaaatttggagtggataacaaagttgacttctatgctgtttcttttgttaaggatgcacaagtagttcatgaactgaagaattatttgaaaagctgtgatgctgatatacacgtcattgtaaaaattgaaagtgcagactctataccaaacttgcattcaattattacagcgtctgatggggccatggttgcaagaggagatcttggtgcagaactccctattgaagaggttccacttttgcaggaagaaataatcaccatatgtcgtagcatgggaaaggccgttattgtggcaacaaatatgctggaaagcatgattgttcacccgacaccaaccagagccgaggtatccgatattgcaattgctgttcgagaaggttctgatgcaataatgctttctggggaaactgctcatggaaagttcccactaaaagccgtgaaagtaatgcacaccgtagcattacggacagaagccactatacctggtggtcaaatgccaccaaatattggtcaagtattcaagaaccacatgagtgagatgtttgcttaccatgcaaccatgatgtctaatacccttggaacctcaactgttgtcttcactagatcaggcttcatggctatccttttgagccactatcgaccttcaggcaccatatttgcttttacagatcaaaagaggatacaacagaggttggctttgtatcaaggagtctgtcctatttacatggaattctctgaagatgctgaagagactttcacaagggccttggatttgctgcagaagcaaggaatggtgaaatcaggagaagaagtagcactagtacaaagtggcacgcaacccatatggaggttccaatccactcacaatatccaggtccgaacagtgtaaacaaaataaaaaggtgaagatggctatgaattaagtttcagtctttcaggacactacattttaatttagaagagcatgttcccttttggtgggttgatgccaatttgataagtccagtagcattttagttgtttgtttgttgcctaggtttttttttttcttcatttattactttcttgttatcattatttttttggtgattgttctatatttatcacggacattagacatatgatagtgtcattgaaattttgattagaaattgcaatgaaaaatgctttcagcc

SEQ ID NO: 811 - protein, 575 aa, Glycine max
MSHVVVTRSIHTSLTRPTSGSAHHRAQTLLKPPTFASKVFPQQRNNPSKVCSRSCLVNARKSAPTEVVPVSPEDDSKIEEELQHSRGMRQLGDTSVGMWSKPTFRRKTKVVCTIGPSTNTREMIWKLAEAGMNVARLNMSHGDHASHQKIIDLVKEYNAQSKDNVIAIMLDTKGPEVRSGDLPQPINLTTGQEFTFTIRRGVGTADCVSVNYDDFVNDVDVGDMLLVDGGMMSLVVKSKTEDSVKCEVVDGGELKSRRHLNVRGKSATLPSITEKDWDDIKFGVDNKVDFYAVSFVKDAQVVHELKNYLKSCDADIHVIVKIESADSIPNLHSIITASDGAMVARGDLGAELPIEEVPLLQEEIITICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETFTRALDLLQKQGMVKSGEEVALVQSGTQPIWRFQSTHNIQVRTV

SEQ ID NO: 812 - DNA, 2284 bp, Zea mays
  CDS (187)..(1914)
gccggccggggcaaaacccgagcctcgcgacctgcttacgagacaagtaatttacgtgcgtcgagttccatctggccttaaacccaccccggcatcgggcacgccgcacgccacgcctcaccgagtcaccgtcccagccagctacccttccccctaccaattccaaatctctcacccggcttcacgatggcggcgcaggtggtcgcagcggcgggcaccccggtggccaggccgctgggcggcggatctggggccgacgcgctccggccagcggcaacgatgccaagggagagaaggaccggtgctgtggccgcgagaggacgccgcgagtctcaggtggtatccgtcataagccgcgccccacgccccgatgccggggtgctgccggtgtcgcccgacgacgacgcggccgtaaaggaagaagcaaacttccagcaccttaaggctatccagcaacttgcaactgcagcaaatggcgtgtggtctaaaccaaatgtaaggcgcaagacaaagattgtgtgtacaatcggtccttcaaccaacacaagggacatgatatggaaactcgctgagactggcatgaatgtggctcggcttaatatgtcacatggagaccatgcatcacaccagaaagttattgatctggtaaaggagtacaatgcatcacatgctgacaatgtgattgctatcatgcttgacacaaagggaccagaagttcgaagtggagatttgcctcaaccgatatttctggaaagcggacaagaatttacttttacaatcaaaaggggagttgggactgatacgtgtgttagcgttaactatgacgactttgttaatgatgttgaagtgggcgacatgctccttgtagatggaggaatgatgtcattcttggtcaaatcaaaaactgaagattctgtgaaatgtgaagttattgacggtggtgaattgaaatctaggcgccatctgaatgttcgtggaaagagtgcaaccttgccatcaataactgacaaggactgggacgacattaagtttggtgtggataatcaagttgattactatgctgtttcttttgtgaaggatgctcaagttgtccacgaactcaaggattatctaaaaagttgcaatgctgacatacatgttatcgtaaaaatagaaagtgcagactccatccccaacttacattcaatcatcacagcatctgatggggctatggttgccaggggtgaccttggagctgagctgcccattgaggaggtgccgctgttgcaggaagaaattattagaatgtgcaggagcatggggaaggctgttattgttgctacaaatatgctcgaaagtatgattgttcatccaactccaacccgagcagaagtttcagacattgctatagctgtccgagagggtgctgatgcagttatgctttcaggagaaactgcacatgggaaatttcccttgaaagctgttaaggtcatgcacactgttgccctgagaaccgaggcaactattcctggtggggaaacacctgcagaccttggtcaggctttcaagaaccacatgagcgaaatgttcgcataccatgcgacaatgatgtcaaatacccttcgaacatcaatagtggttttcactaggacgggatttatggctatactgcttagtcactaccgtccatctggcactatttttgccttcacagacgaggagagagttaggcaacgattggctttgtaccaaggtgtatgtccggttcaaatggaattttctgatgatgctgagaagacatttggcaatgctttgtcttatttgctgaaacatggtatggttaaggacggtaaggaggttgcacttgttcaaagtggtaaacatcccatctggagatcacaatcaacacacaacattcaggtgaggaagatctgatgcggaacgcacatagtattctgattgttggaggacatcgtttcttctagcaaaccgcaaggtcttgttacaatgaaactacactggtagtaagtactggtattggtgagatagttggtgctgagctagtgttgtgattctttttcttacttgtgcactagtgctgttttccttccgtgtaaaaaggccaatccaattgccgcttggttttagctgtagctttggaacactgtaggcttgttgttgtaatacagttcgttccatttgtcaatgttaaggacttttgcctcgagagctaggcataactcgaagctcaccaaacagcaatctacctgcaaattgcaacgcattttgcgtatttaaagcggcc

SEQ ID NO: 813 - protein, 575 aa, Zea mays
MAAQVVAAAGTPVARPLGGGSGADALRPAATMPRERRTGAVAARGRRESQVVSVISRAPRPDAGVLPVSPDDDAAVKEEANFQHLKAIQQLATAANGVWSKPNVRRKTKIVCTIGPSTNTRDMIWKLAETGMNVARLNMSHGDHASHQKVIDLVKEYNASHADNVIAIMLDTKGPEVRSGDLPQPIFLESGQEFTFTIKRGVGTDTCVSVNYDDFVNDVEVGDMLLVDGGMMSFLVKSKTEDSVKCEVIDGGELKSRRHLNVRGKSATLPSITDKDWDDIKFGVDNQVDYYAVSFVKDAQVVHELKDYLKSCNADIHVIVKIESADSIPNLHSIITASDGAMVARGDLGAELPIEEVPLLQEEIIRMCRSMGKAVIVATNMLESMIVHPTPTRAEVSDIAIAVREGADAVMLSGETAHGKFPLKAVKVMHTVALRTEATIPGGETPADLGQAFKNHMSEMFAYHATMMSNTLRTSIVVFTRTGFMAILLSHYRPSGTIFAFTDEERVRQRLALYQGVCPVQMEFSDDAEKTFGNALSYLLKHGMVKDGKEVALVQSGKHPIWRSQSTHNIQVRKI

SEQ ID NO: 814 - DNA, 3679 bp, Zea mays
  CDS (874)..(2580)
tacttcccctagtgttatagcatctgggcagggaccgcagtccgaggagttttctccaagccacctaaggagaaggtctggatcgcatccaacactggtggcgaacacccttcgcacaccaatcattgtatttacacagccaggccccatggttgtcctcctgagcgactatcgtccctcggcgacactatttgcgtttacaaacgaggaacgagtgaagcaacggctagcactctaccagggggtcatccctattcacatgcagttctctgacgacgcagaagaaactttctccagagcaattagcagcttgctgaaggcacaatatgtgaagaagggagactacgtcactcttgttcagagcggagtgacttcaatctggagagaggaatccactcaccacatccaagtgaggagagctcaggtctgatgtgctggtgggaatcagtcgccggagaagttttgatagcgccgctagaagtgttatcatcatcatcaccattatatgcgagtaattttaatgtttttaccaggagattgctacgtcgagttgtatgttgtgtcgaattcacgtgtagactctggacctttaaaaaaaaaaaaaaaaaaaaaaaaaaattcaggggtgtggaccgcgccctgcaccctggcgcgtgggcccgcctcctccatctccccctgcggcgtaataagaagcgacccacggccaccgccacggccgcgccggaatatcatacgaaaaccctcgcggcgaggagcgctctccgtcccacacacgcgcgccgcagcctccgcagtccgcacctgcctccacgacttgtcgtgctcgtgcgctactctcctcgagcgcggcgcggagcacggggacatcaaatggcggcagcggcggagatcggtggtttcgcggcggcgagagtggcggtggcgacgctcaggccggctgcgcacccagccccggcggcggcaccgcagcagcctaggagggcggtggcggcgcagtcgctgcggacgaccgccaccgaggcgctgacggcggatctcgccggcacgaccaacggcgctgtgcatgctcggatgaatagtaaggctacaagtgaaatcacttcacaggcagttactgcaaattctaggagaaagacaaagatagtctgcaccataggtccctcaaccaacactcgtgagatgatttggaagcttgcagagactggaatgaatgtagcacgccttaatatgtcccatggtgaccaccagtcgcaccagaaggttattgatttggtcaaggagtacaatgcacagaacactgatggcaatgttattgccattatgctggacacaaagggtcctgaagttagaagtggggatgttccagagccaatcatgctcaaggaaggtcaagagttcaacttcacgattaaaagaggggtgagcactgaagacactgtcagcgtgaactatgatgacttcataaatgatgttgaagctggcgacatactattagtggatggaggaatgatgtcgcttgctgtgaagtctaaaacagccgatacagtcaagtgtaaagtagttgatggtggggaattgaaatcacggcgccacctaaatgtccgtggaaagagtgctactttgccatctatcactgagaaggattgggaagacataaaatttggtgtcgaaaacggtgttgatttctatgcagtttcctttgtgaaggatgccaaagttatccatgaattaaaagactaccttaaaagtgctaatgccgatatacatgtcattccaaaaattgaaagtgcagattcaataccaaacctgcagtccattattgctgcttcagatggggcaatggtggcgcgtggagaccttggtgctgaacttccgattgaggatgttcctttgctacaggcagagattgtccaaacatgtcgaagcatggagaaaccagtcattgtcgctacaaatatgttggaaagcatgattgaccatcctactcccactagggcagaagtttctgacatagctattgcagttcgggaaggtgctgatgccatcatgttatctggcgaaactgctcatggaaagtatccactaaaggcagtcaaggtgatgcacactgtggcactcagaacagaatccagcctttataacccaactacttctcctagtcttgttgcatctgcacagggtctacagaatgaggacttctccccaagccagctaagtaaaatgttcggatctcatgcaacgatgatggccaacacccttcgcacaccaatcattgtatttacacagacaggctccatggctgtcctcctgagccattatcgtccctcgtctacactatttgcatttacaaacgaggaacgagtgaagcaacggctagcactctaccagggcgtcatccctattcacatgcagttctctgacgacgcagaagaaactttctccagagcaattagcagcttgctgaaagcacaatatgtgaagaagggagactacgtcactcttgttcagagcggagtgacttcaatctggagagaggaatccactcaccacatccaagtgaggaaagttcaggtctgatgtgccggtgggaattggtcgtctgagaaattttgatagcgccgcctgatgtgttatcatcattatatgtgtaattttactgttttaccaggagattgctacgtcgagttatatgttgtgtcgaattcacgtgtaggctctgaatcttgactgtgtccgttcattttcgcttgtttcacactgaagtgttataagctcaactttactgcttttgttttcttgtgaaacttgagtttagtttcttgttacaaaaggagctagcactaacagggtggtgagttttgtaaaaacggggcgaggactgttgagttaaaactgttgtaataatgatatcgttcctgcaagacgacacatgcatggccagaaggccaaagtctgaactcttttttgccgggcaagacaggatgcccatgttcattgtcgtggtggcatgatgcttgctagccttttctgcccctccgcatcatgtcaaggggataacctgcagcggatgtggacccagcagattgggcacggaacacacgtctatcacgaccatccgcgaaaagtgctcgaacattataacgttccagttgctagcttcggattccccgcaaggtttcaaacttgagccccgccgccccgggcagggaggtaaattaatttattctttgtttttttgtaagtgccccctaaacgttttaatggacatgtagtcatagattatctaagtttttcggtcttttttgtttttaaaattttttttttttttttttttttttttttttttttttttagatcgagaccgctgactacactgactcgaggactatgtgactccatagtgctgttgatgctgacttcgtgctcttccatcctgccggggtgatgaggactgatgcgatgatgacacagctgtgaaggtggttgatattgttgacacattccgtctacaggagcatcctccttttgacaagaaatcatttgtgtcttacatcagtgaatacatcaagaatctcactgctgtgttggagccagatgaagcggatgagttcaaaaagggtgtcgagggtgccacctagtttctccttagcaagcttgaaggacctgcaattttttg

SEQ ID NO: 815 - protein, 568 aa, Zea mays
MAAAAEIGGFAAARVAVATLRPAAHPAPAAAPQQPRRAVAAQSLRTTATEALTADLAGTTNGAVHARMNSKATSEITSQAVTANSRRKTKIVCTIGPSTNTREMIWKLAETGMNVARLNMSHGDHQSHQKVIDLVKEYNAQNTDGNVIAIMLDTKGPEVRSGDVPEPIMLKEGQEFNFTIKRGVSTEDTVSVNYDDFINDVEAGDILLVDGGMMSLAVKSKTADTVKCKVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEDVPLLQAEIVQTCRSMEKPVIVATNMLESMIDHPTPTRAEVSDIAIAVREGADAIMLSGETAHGKYPLKAVKVMHTVALRTESSLYNPTTSPSLVASAQGLQNEDFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 816 - protein, 589 aa, Artificial sequence
  Description of artificial sequence: consensus sequence
  Variant (2)..(71): Xaa in position 2 to 71 is any amino acid
  Variant (72)..(109): Xaa in position 72 to 109 is any or no amino acid
  Variant (119)..(119): Xaa in position 119 is any amino acid
  Variant (124)..(125): Xaa in position 124 to 125 is any amino acid
  Variant (135)..(135): Xaa in position 135 is any amino acid
  Variant (142)..(142): Xaa in position 142 is any amino acid
  Variant (150)..(150): Xaa in position 150 is any amino acid
  Variant (153)..(155): Xaa in position 153 to 155 is any amino acid
  Variant (164)..(167): Xaa in position 164 to 167 is any amino acid
  Variant (169)..(170): Xaa in position 169 to 170 is any amino acid
  Variant (171)..(171): Xaa in position 171 is any or no amino acid
  Variant (188)..(188): Xaa in position 188 is any amino acid
  Variant (190)..(190): Xaa in position 190 is any amino acid
  Variant (193)..(193): Xaa in position 193 is any amino acid
  Variant (195)..(196): Xaa in position 195 to 196 is any amino acid
  Variant (201)..(201): Xaa in position 201 is any amino acid
  Variant (205)..(205): Xaa in position 205 is any amino acid
  Variant (209)..(209): Xaa in position 209 is any amino acid
  Variant (211)..(213): Xaa in position 211 to 213 is any amino acid
  Variant (222)..(222): Xaa in position 222 is any amino acid
  Variant (227)..(227): Xaa in position 227 is any amino acid
  Variant (230)..(230): Xaa in position 230 is any amino acid
  Variant (240)..(241): Xaa in position 240 to 241 is any amino acid
  Variant (247)..(247): Xaa in position 247 is any amino acid
  Variant (249)..(249): Xaa in position 249 is any amino acid
  Variant (253)..(253): Xaa in position 253 is any amino acid
  Variant (255)..(255): Xaa in position 255 is any amino acid
  Variant (280)..(280): Xaa in position 280 is any amino acid
  Variant (284)..(284): Xaa in position 284 is any amino acid
  Variant (291)..(291): Xaa in position 291 is any amino acid
  Variant (293)..(293): Xaa in position 293 is any amino acid
  Variant (306)..(306): Xaa in position 306 is any amino acid
  Variant (308)..(308): Xaa in position 308 is any amino acid
  Variant (313)..(313): Xaa in position 313 is any amino acid
  Variant (316)..(319): Xaa in position 316 to 319 is any amino acid
  Variant (326)..(326): Xaa in position 326 is any amino acid
  Variant (338)..(338): Xaa in position 338 is any amino acid
  Variant (342)..(342): Xaa in position 342 is any amino acid
  Variant (344)..(344): Xaa in position 344 is any amino acid
  Variant (362)..(362): Xaa in position 362 is any amino acid
  Variant (365)..(365): Xaa in position 365 is any amino acid
  Variant (368)..(368): Xaa in position 368 is any amino acid
  Variant (371)..(373): Xaa in position 371 to 373 is any amino acid
  Variant (376)..(376): Xaa in position 376 is any amino acid
  Variant (378)..(378): Xaa in position 378 is any amino acid
  Variant (380)..(380): Xaa in position 380 is any amino acid
  Variant (393)..(393): Xaa in position 393 is any amino acid
  Variant (416)..(416): Xaa in position 416 is any amino acid
  Variant (427)..(427): Xaa in position 427 is any amino acid
  Variant (432)..(433): Xaa in position 432 to 433 is any amino acid
  Variant (444)..(451): Xaa in position 444 to 451 is any amino acid
  Variant (452)..(452): Xaa in position 452 is any or no amino acid
  Variant (454)..(465): Xaa in position 454 to 465 is any amino acid
  Variant (466)..(474): Xaa in position 466 to 474 is any or no amino acid
  Variant (477)..(478): Xaa in position 477 to 478 is any amino acid
  Variant (481)..(482): Xaa in position 481 to 482 is any amino acid
  Variant (484)..(484): Xaa in position 484 is any amino acid
  Variant (488)..(488): Xaa in position 488 is any amino acid
  Variant (490)..(492): Xaa in position 490 to 492 is any amino acid
  Variant (496)..(496): Xaa in position 496 is any amino acid
  Variant (499)..(499): Xaa in position 499 is any amino acid
  Variant (502)..(502): Xaa in position 502 is any amino acid
  Variant (511)..(511): Xaa in position 511 is any amino acid
  Variant (513)..(514): Xaa in position 513 to 514 is any amino acid
  Variant (518)..(523): Xaa in position 518 to 523 is any amino acid
  Variant (533)..(533): Xaa in position 533 is any amino acid
  Variant (536)..(536): Xaa in position 536 is any amino acid
  Variant (538)..(538): Xaa in position 538 is any amino acid
  Variant (540)..(540): Xaa in position 540 is any amino acid
  Variant (545)..(545): Xaa in position 545 is any amino acid
  Variant (548)..(549): Xaa in position 548 to 549 is any amino acid
  Variant (551)..(553): Xaa in position 551 to 553 is any amino acid
  Variant (555)..(560): Xaa in position 555 to 560 is any amino acid
  Variant (562)..(562): Xaa in position 562 is any amino acid
  Variant (564)..(568): Xaa in position 564 to 568 is any amino acid
  Variant (573)..(575): Xaa in position 573 to 575 is any amino acid
  Variant (579)..(580): Xaa in position 579 to 580 is any amino acid
  Variant (584)..(584): Xaa in position 584 is any amino acid
AXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRKTKIVCTXGPSTXXREMIWKLAEXGMNVARXNMSHGDHXSHXXXIDLVKEYNXXXXDXXXIAIMLDTKGPEVRSGDXPXPIXLXXGQEFXFTIXRGVXTXXXVSVNYDDFXNDVEXGDXLLVDGGMMSXXVKSKTXDXVKCXVXDGGELKSRRHLNVRGKSATLPSITXKDWXDIKFGVXNXVDFYAVSFVKDAXVXHELKXYLXXXXADIHVIXKIESADSIPNLXSIIXAXDGAMVARGDLGAELPIEXVPXLQXEIXXXCRXMXKXVIVATNMLESMIXHPTPTRAEVSDIAIAVREGADAXMLSGETAHGKXPLKAXXVMHTVALRTEXXXXXXXXXPXXXXXXXXXXXXXXXXXXXXXMFXXHAXXMXNTLXTXXXVFTXTGXMAXLLSHYRPSXTXXAFTXXXXXXQRLALYQGVXPIXMXFXDDAEXTFXXAXXXLXXXXXXKXGXXXXXVQSGXXXIWRXXSTHXIQVRK

SEQ ID NO: 817 - protein, 59 aa, Artificial sequence
  Description of artificial sequence: amino acid sequence pattern comprised in a variant of SEQ ID NO: 779
  Variant (10)..(10): Xaa in position 10 is Ile or Val
  Variant (14)..(14): Xaa in position 14 is Ser or Thr
  Variant (15)..(15): Xaa in position 15 is Asn or Ser
  Variant (16)..(16): Xaa in position 16 is Ser or Thr
  Variant (17)..(17): Xaa in position 17 is Lys or Arg
  Variant (18)..(18): Xaa in position 18 is Asp or Glu
  Variant (26)..(26): Xaa in position 26 is Ala or Thr
  Variant (33)..(33): Xaa in position 33 is Leu or Met
  Variant (41)..(41): Xaa in position 41 is Ala or Gln
  Variant (44)..(45): Xaa in position 44 to 45 is any amino acid
  Variant (46)..(46): Xaa in position 46 is Thr or Val
  Variant (48)..(48): Xaa in position 48 is Asp or Asn
  Variant (55)..(55): Xaa in position 55 is Ala or Ser
  Variant (56)..(58): Xaa in position 56 to 58 is any amino acid
RRKTKIVCTXGPSXXXXXMIWKLAEXGMNVARXNMSHGDHXSHXXXIXLVKEYNXXXXD

SEQ ID NO: 818 - protein, 60 aa, Artificial sequence
  Description of artificial sequence: amino acid sequence pattern comprised in a variant of SEQ ID NO: 779
  Variant (10)..(10): Xaa in position 10 is Asp, Asn or Val
  Variant (30)..(30): Xaa in position 30 is Ala or Ser
  Variant (32)..(32): Xaa in position 32 is Ala or Gly
  Variant (33)..(33): Xaa in position 33 is Ile or Val
  Variant (44)..(44): Xaa in position 44 is Phe or Tyr
  Variant (49)..(49): Xaa in position 49 is Ala or Val
  Variant (50)..(50): Xaa in position 50 is any amino acid
  Variant (57)..(57): Xaa in position 57 is any amino acid
ATNMLESMIXHPTPTRAEVSDIAIAVREGXDXXMLSGETAHGKXPLKAXXVMHTVAXRTE

SEQ ID NO: 819 - protein, 59 aa, Artificial sequence
  Description of artificial sequence: amino acid sequence pattern comprised in a variant of SEQ ID NO: 779
  Variant (9)..(9): Xaa in position 9 is Leu or Val
  Variant (11)..(11): Xaa in position 11 is Glu or Gln
  Variant (14)..(14): Xaa in position 14 is Phe or Met
  Variant (16)..(16): Xaa in position 16 is any amino acid
  Variant (17)..(17): Xaa in position 17 is Glu, Pro, Ser or Thr
  Variant (22)..(22): Xaa in position 22 is Asn or Thr
  Variant (26)..(26): Xaa in position 26 is Glu or Lys
  Variant (30)..(30): Xaa in position 30 is Gly or Ser
  Variant (31)..(32): Xaa in position 31 to 32 is any amino acid
  Variant (33)..(33): Xaa in position 33 is Asp, Ser or Thr
  Variant (34)..(34): Xaa in position 34 is Cys or Thr
  Variant (43)..(43): Xaa in position 43 is Ile or Val
  Variant (48)..(48): Xaa in position 48 is Ala or Val
  Variant (51)..(51): Xaa in position 51 is Ile or Met
GPEVRSGDXPXPIXLXXGQEFXFTIXRGVXXXXXVSVNYDDFXNDVEXGDXLLVDGGMM

SEQ ID NO: 820 - protein, 59 aa, Artificial sequence
  Description of artificial sequence: amino acid sequence pattern comprised in a variant of SEQ ID NO: 779
  Variant (3)..(3): Xaa in position 3 is any amino acid
  Variant (5)..(5): Xaa in position 5 is Pro or Ser
  Variant (6)..(6): Xaa in position 6 is any amino acid
  Variant (7)..(7): Xaa in position 7 is Ile or Val
  Variant (11)..(11): Xaa in position 11 is Gln or Arg
  Variant (14)..(14): Xaa in position 14 is any amino acid
  Variant (17)..(17): Xaa in position 17 is Ile or Val
  Variant (25)..(25): Xaa in position 25 is any amino acid
  Variant (26)..(26): Xaa in position 26 is Gly or Ser
  Variant (28)..(28): Xaa in position 28 is Ile or Leu
  Variant (29)..(29): Xaa in position 29 is Phe or Tyr
  Variant (33)..(33): Xaa in position 33 is Asp or Asn
  Variant (34)..(34): Xaa in position 34 is Glu or Gln
  Variant (35)..(35): Xaa in position 35 is any amino acid
  Variant (36)..(36): Xaa in position 36 is Lys or Arg
  Variant (37)..(37): Xaa in position 37 is Ile or Val
  Variant (38)..(39): Xaa in position 38 to 39 is any amino acid
  Variant (45)..(45): Xaa in position 45 is any amino acid
  Variant (48)..(48): Xaa in position 48 is any amino acid
  Variant (49)..(49): Xaa in position 49 is Pro or Ser
  Variant (50)..(50): Xaa in position 50 is Ile or Val
  Variant (51)..(51): Xaa in position 51 is any amino acid
  Variant (53)..(53): Xaa in position 53 is any amino acid
  Variant (55)..(55): Xaa in position 55 is Ser or Thr
  Variant (56)..(56): Xaa in position 56 is Asp or Asn
  Variant (58)..(58): Xaa in position 58 is Ala or Val
TLXTXXXVFTXTGXMAXLLSHYRPXXTXXAFTXXXXXXXRLALYXGVXXXXMXFXXDXE

SEQ ID NO: 821 - protein, 38 aa, Artificial sequence
  Description of artificial sequence: amino acid sequence pattern comprised in a variant of SEQ ID NO: 779
  Variant (2)..(2): Xaa in position 2 is any or no amino acid
  Variant (4)..(8): Xaa in position 4 to 8 is any amino acid
  Variant (9)..(9): Xaa in position 9 is any or no amino acid
  Variant (11)..(11): Xaa in position 11 is Asp, Glu or Lys
  Variant (13)..(14): Xaa in position 13 to 14 is any amino acid
  Variant (15)..(15): Xaa in position 15 is Ile or Val
  Variant (16)..(16): Xaa in position 16 is Ala or Thr
  Variant (17)..(17): Xaa in position 17 is Ile or Leu
  Variant (22)..(23): Xaa in position 22 to 23 is any amino acid
  Variant (24)..(24): Xaa in position 24 is Pro or Ser
  Variant (28)..(28): Xaa in position 28 is Glu, Arg or Ser
  Variant (29)..(29): Xaa in position 29 is any amino acid
  Variant (33)..(33): Xaa in position 33 is any amino acid
  Variant (38)..(38): Xaa in position 38 is Lys or Arg
LXLXXXXXXKXGXXXXXVQSGXXXIWRXXSTHXIQVRX

SEQ ID NO: 822 - protein, 16 aa, Artificial sequence
  Description of artificial sequence: amino acid sequence pattern comprised in a variant of SEQ ID NO: 779
  Variant (2)..(2): Xaa in position 2 is any amino acid
  Variant (3)..(7): Xaa in position 3 to 7 is any or no amino acid
  Variant (9)..(9): Xaa in position 9 is Ala or Gly
  Variant (10)..(10): Xaa in position 10 is any amino acid
  Variant (13)..(13): Xaa in position 13 is Ser or Thr
  Variant (14)..(14): Xaa in position 14 is Ile or Met
  Variant (16)..(16): Xaa in position 16 is Ala or Ser
KXXXXXXFXXHAXXMX

SEQ ID NO: 823 - protein, 14 aa, Artificial sequence
  Description of artificial sequence: amino acid sequence pattern comprised in a variant of SEQ ID NO: 779
  Variant (2)..(3): Xaa in position 2 to 3 is any or no amino acid
  Variant (9)..(9): Xaa in position 9 is any amino acid
  Variant (11)..(11): Xaa in position 11 is any amino acid
SXXVKSKTXDXVKC

SEQ ID NO: 824 - protein, 7 aa, Artificial sequence
  Description of artificial sequence: amino acid sequence pattern comprised in a variant of SEQ ID NO: 779
IAIMLDT

The invention claimed is:

1. A method for the manufacture of a polypeptide capable of increasing the content of total fatty acids in seed when expressed in a transgenic plant relative to a corresponding control plant comprising:
    (a) expressing in a host cell a polynucleotide, wherein the polynucleotide comprises a nucleic acid sequence selected from the group consisting of:
        (i) the nucleic acid sequence of SEQ ID NO: 778;
        (ii) a nucleic acid sequence encoding a polypeptide comprising the amino acid sequence of SEQ ID NO: 779; and
        (iii) a nucleic acid sequence which is at least 90% identical to the nucleic acid sequence of (i) or (ii), wherein said nucleic acid sequence encodes a polypeptide capable of increasing the content of total fatty acids in seed when expressed in a transgenic plant relative to a corresponding control plant; and
    (b) obtaining the polypeptide encoded by said polynucleotide from the host cell.

2. A method for the manufacture of a lipid or a fatty acid in a plant cell, plant, or part thereof, or progeny therefrom comprising:
    (a) expressing in a transgenic plant cell, plant, or part thereof, or progeny therefrom a polynucleotide, wherein the polynucleotide comprises a nucleic acid sequence selected from the group consisting of:
        (i) the nucleic acid sequence of SEQ ID NO: 778;
        (ii) a nucleic acid sequence encoding a polypeptide comprising the amino acid sequence of SEQ ID NO: 779; and
        (iii) a nucleic acid sequence which is at least 90% identical to the nucleic acid sequence of (i) or (ii), wherein said nucleic acid sequence encodes a polypeptide capable of increasing the content of total fatty acids in seed when expressed in a transgenic plant;
    (b) cultivating the transgenic plant cell, plant, or part thereof, or progeny therefrom of (a) under conditions allowing synthesis of said fatty acid; and
    (c) obtaining said fatty acid from the transgenic plant cell, plant, or part thereof, or progeny therefrom.

3. A method for the manufacture of a plant having increased content of total fatty acids in seed of a plant relative to a corresponding control plant comprising:
    (a) introducing into a plant cell a polynucleotide, wherein the polynucleotide comprises a nucleic acid sequence selected from the group consisting of:
        (i) the nucleic acid sequence of SEQ ID NO: 778;
        (ii) a nucleic acid sequence encoding a polypeptide comprising the amino acid sequence of SEQ ID NO: 779; and
        (iv) a nucleic acid sequence which is at least 90% identical to the nucleic acid sequence of (i) or (ii), wherein said nucleic acid sequence encodes a polypeptide capable of increasing the content of total fatty acids in seed when expressed in a transgenic plant relative to a corresponding control plant; and (b) generating a transgenic plant from said plant cell, wherein the polypeptide encoded by the polynucleotide when expressed in the transgenic plant increases the content of total fatty acids in seed of the transgenic plant relative to a corresponding control plant.

4. The method of claim 1, wherein the polynucleotide comprises a nucleic acid sequence which is at least 95% identical to the nucleic acid sequence of (i) or (ii), wherein said nucleic acid sequence encodes a polypeptide capable of increasing the content of total fatty acids in seed when expressed in a transgenic plant relative to a corresponding control plant.

5. The method of claim 2, wherein the polynucleotide comprises a nucleic acid sequence which is at least 95% identical to the nucleic acid sequence of (i) or (ii), wherein said nucleic acid sequence encodes a polypeptide capable of increasing the content of total fatty acids in seed when expressed in a transgenic plant relative to a corresponding control plant.

6. The method of claim 3, wherein the polynucleotide comprises a nucleic acid sequence which is at least 95% identical to the nucleic acid sequence of (i) or (ii), wherein said nucleic acid sequence encodes a polypeptide capable of increasing the content of total fatty acids in seed when expressed in a transgenic plant relative to a corresponding control plant.

7. The method of claim 1, wherein the polynucleotide comprises the nucleic acid sequence of (i) or (ii), wherein said nucleic acid sequence encodes a polypeptide capable of increasing the content of total fatty acids in seed when expressed in a transgenic plant relative to a corresponding control plant.

8. The method of claim 2, wherein the polynucleotide comprises the nucleic acid sequence of (i) or (ii), wherein said nucleic acid sequence encodes a polypeptide capable of increasing the content of total fatty acids in seed when expressed in a transgenic plant relative to a corresponding control plant.

9. The method of claim 3, wherein the polynucleotide comprises the nucleic acid sequence of (i) or (ii), wherein said nucleic acid sequence encodes a polypeptide capable of increasing the content of total fatty acids in seed when expressed in a transgenic plant relative to a corresponding control plant.

10. The method of claim 1, wherein the polynucleotide comprises a nucleic acid sequence encoding a polypeptide comprising an amino acid sequence having greater than 95% sequence identity to the amino acid sequence of SEQ ID NO: 779, wherein said nucleic acid sequence encodes a polypeptide capable of increasing the content of total fatty acids in seed when expressed in a transgenic plant relative to a corresponding control plant.

11. The method of claim 2, wherein the polynucleotide comprises a nucleic acid sequence encoding a polypeptide comprising an amino acid sequence having greater than 95% sequence identity to the amino acid sequence of SEQ ID NO: 779, wherein said nucleic acid sequence encodes a polypeptide capable of increasing the content of total fatty acids in seed when expressed in a transgenic plant relative to a corresponding control plant.

12. The method of claim 3, wherein the polynucleotide comprises a nucleic acid sequence encoding a polypeptide comprising an amino acid sequence having greater than 95% sequence identity to the amino acid sequence of SEQ ID NO: 779, wherein said nucleic acid sequence encodes a polypeptide capable of increasing the content of total fatty acids in seed when expressed in a transgenic plant relative to a corresponding control plant.

13. The method of claim 3, further comprising obtaining transgenic progeny from the transgenic plant, or transgenic seed from the transgenic plant or from progeny therefrom, wherein the transgenic progeny or transgenic seed comprise the polynucleotide.

14. The method of claim 3, further comprising selecting a transgenic plant or transgenic progeny therefrom having increased content of total fatty acids relative to a corresponding control plant, wherein the transgenic plant or transgenic progeny comprise the polynucleotide.

15. The method of claim 1, wherein the polynucleotide is operably linked to a seed-specific promoter.

16. The method of claim 2, wherein the polynucleotide is operably linked to a seed-specific promoter.

17. The method of claim 3, wherein the polynucleotide is operably linked to a seed-specific promoter.

* * * * *